US012790595B2

(12) United States Patent
Webb et al.

(10) Patent No.: US 12,790,595 B2

(45) Date of Patent: Nov. 10, 2026

(54) MUTANT NUDIVIRUS INSECT CONTROL

(71) Applicant: UNIVERSITY OF KENTUCKY RESEARCH FOUNDATION, Lexington, KY (US)

(72) Inventors: Bruce Webb, Lexington, KY (US); Emrah Ozel, College Station, TX (US)

(73) Assignee: UNIVERSITY OF KENTUCKY RESEARCH FOUNDATION, Lexington, KY (US)

(*) Notice: Subject to any disclaimer, the term of this patent is extended or adjusted under 35 U.S.C. 154(b) by 821 days.

(21) Appl. No.: 18/066,224

(22) Filed: Dec. 14, 2022

(65) Prior Publication Data

US 2023/0159900 A1 May 25, 2023

Related U.S. Application Data

(63) Continuation-in-part of application No. 16/722,071, filed on Dec. 20, 2019, now Pat. No. 11,591,575, which is a continuation of application No. 15/694,323, filed on Sep. 1, 2017, now abandoned, which is a continuation of application No. 15/154,069, filed on May 13, 2016, now Pat. No. 9,770,033.

(60) Provisional application No. 62/161,674, filed on May 14, 2015.

(51) Int. Cl.
*C12N 7/00* (2006.01)
*A01N 63/40* (2020.01)

(52) U.S. Cl.
CPC ............... *C12N 7/00* (2013.01); *A01N 63/40* (2020.01); *C12N 2710/00021* (2013.01); *C12N 2710/00031* (2013.01); *C12N 2710/00071* (2013.01)

(58) Field of Classification Search
None
See application file for complete search history.

(56) References Cited

U.S. PATENT DOCUMENTS

| | | | |
|---|---|---|---|
| 7,261,886 | B2 | 8/2007 | Wu et al. |
| 7,476,499 | B2 | 1/2009 | Kirkegaard et al. |
| 9,770,033 | B2 | 9/2017 | Webb et al. |
| 11,591,575 | B2 | 2/2023 | Webb et al. |
| 2011/0314562 | A1 | 12/2011 | Lu et al. |
| 2018/0064113 | A1 | 3/2018 | Webb et al. |

FOREIGN PATENT DOCUMENTS

| | | | |
|---|---|---|---|
| WO | 96/16538 | A1 | 6/1996 |
| WO | 2004/021781 | A2 | 3/2004 |

OTHER PUBLICATIONS

Nugnes et al. The Membrane-Anchoring Region of the AcMNPV P74 protein is Expendable or Interchangable with Homologs from Other Species. Viruses, 2021. 13,2416. 17 pages.*

Marini et al. The Use of Orthologous Sequences To Predict The Impact of Amino Acid Substitutions on Protein Function. PLOS genetics, 2010. 6(5): e1000698, 11 pages.*

Webb, B., et al., "Contributed pater 225: Latency-deficient recombinant and mutant Helicoverpa zea nudiviruses that cause enhanced pathology and sterility to their insect hosts," 49th Annual Meeting of the Society for Invertebrate Pathology, Tours 2016, Jul. 28, 2016, p. 90, 1 pg.

Lee, J.C., et al., "Superinfection-Induced Apoptosis and its Correlation with the Reduction of Viral Progeny in Cells Persistently Infected with Hz-1 Baculovirus," J Virol., Dec. 1993, 67(12):6989-94, 6 pgs., PMID: 8230422.

Lee, S., et al., "First Report of Oryctes rhinoceros nudivirus (Coleoptera: Scarabaeidae) Causing Severe Disease in Allomyrina dichotoma in Korea," J Insect Sci, 2015, 12:15, 3 pgs., PubMed PMID: 25765317.

Lin, C.L., et al., "Persistent Hz-1 Virus Infection in Insect Cells: Evidence for Insertion of Viral DNA into Host Chromosomes and Viral Infection in a Latent Status," J Virol., Jan. 1999, 73(1):128-39, 12 pgs., PMID: 9847315.

Liu, X., et al., "Synergistic effects of Cydia pomonella granulovirus GP37 on the infectivity of nucleopolyhedroviruses and the lethality of Bacillus thuringiensis," Arch Virol, 2011, 156:1707-1715, 9 pgs.

Lupiani, B., et al., "Development and Use of a PCR Assay for Detection of the Reproductive Virus in Wild Populations of Helicoverpa zea (Lepidoptera: noctuidae)," J Invertebr Pathol, 1999, 73:107-112, 6 pgs.

Luttrell, R.G., et al., "Helicoverpa zea and Bt cotton in the United States," GM Crops & Food: Biotechnol in Agriculture Food Chain, 2012, 3(3):213-227, 15 pgs.

Martinez, A.M., et al., "Effects of optical brighteners used in biopesticide formulations on crops: reflectance, stomatal conductance, photosynthesis, and growth," Commun Agric Appl Biol Sci, 2009, 74(1):117-123, 8 pg.

Morrison, N.I., et al., "Engineered Repressible Lethality for Controlling the Pink Bollworm, a Lepidopteran Pest of Cotton," PLoS One, Dec. 2012, 7(12):e50922, 10 pgs., PMID: 23226548.

Nguyen, Q., et al., "Genome scale analysis of differential mRNA expression of Helicoverpa zea insect cells infected with a H. armigera baculovirus," Virology 444(1- 2):158-170, 13 pgs., PMID: 23827436.

Nguyen, Q., et al., "Transcriptome Sequencing of and Microarray Development for a Helicoverpa zea Cell Line to Investigate In Vitro Insect Cell-Baculovirus Interactions," PLoS One, May 2012, 7(5):e36324, 15 pgs., PMID: 22629315.

(Continued)

*Primary Examiner* — Christopher M Babic
*Assistant Examiner* — Kimberly A Aron

(57) ABSTRACT

Disclosed are the *H. zea* nudivirus sequence and two additional related sequences from *H. virescens* and *H. armigera* nudiviruses for development of genetically modified nudiviruses capable of being sexually transmitted by an insect useful for controlling pest populations. Such genetically modified nudiviruses are capable of causing sterility in a target population of insects. Previously disclosed were insects infected with the previously disclosed genetically modified *H. zea* nudivirus, methods of making genetically modified nudiviruses, and methods of using genetically modified nudiviruses to control an insect pest population.

2 Claims, 15 Drawing Sheets

Specification includes a Sequence Listing.

(56) References Cited

OTHER PUBLICATIONS

Olsen, O-A., et al., "The mutagenic effects of diepoxybutane in wild-type and mutagen-sensitive mutants of Drosophila melanogaster," Mutat Res, 1982, 92(1-2):107-115, 9 pgs.
Pichon, A., et al., "Recurrent DNA virus domestication leading to different parasite virulence strategies," Sci Adv, 2015, 1(10):e1501150, 9 pgs., PMID: 26702449.
Pushparajan, C., et al., "Characterization of growth and Oryctes rhinoceros nudivirus production in attached cultures of the DSIR-HA-1179 coleopteran insect cell line," Cytotechnology, 2013, 65(6):1003-1016, 14 pgs., PMID: 23979321.
Raina, A.K., et al., "Gonad-specific virus of corn earworm," Nature, Apr. 27, 1995, 374:770, 1 pg.
Raina, A.K., et al., "Further Characterization of the Gonad-Specific Virus of Corn Earworm, *Helicoverpa zea*," J Invertebr Pathol, 2000, 76:6-12, 7 pgs., PMID:10963397.
Raina, A.K., et al., "Acquisition, persistence, and species susceptibility of the Hz-2V virus," J Invertebr Pathol, 2006 93:71-74, 4 pgs.
Rallis, C.P., et al., "Pathology and ultrastructure of Hz-2V infection in the agonadal female corn earworm, *Helicoverpa zea*," J Invertebr Pathol, 2000, 81:33-44, 12 pgs., PMID:12417211.
Rallis, C.P., et al., "Pathology and ultrastructure of the insect virus, Hz-2V, infecting agonadal male corn earworms, *Helicoverpa zea*," J Invertebr Pathol, 2002, 80:81-89, 9 pgs., PMID: 12383433.
Reardon, J.T., et al., "Molecular Analysis of Diepoxybutane-Induced Mutations at the rosy Locus of *Drosophila melanogaster*," Genetics, 1987, 115:323-331, 9 pgs., PMID:17246369.
Simmons, G.S., et al., "Field Performance of a Genetically Engineered Strain of Pink Bollworm," PLoS One, Sep. 2011, 6(9):e24110, 11 pgs., PMID: 21931649.
Skalsky, R.L., et al., "Viruses, microRNAs, and Host Interactions," Annu Rev Microbiol, 2010, 64:123-41, 23 pgs., PMID: 20477536.
Smith-Pardo, A., "The Old World Bollworm *Helicoverpa armigera* (Hübner) (Lepidoptera: Noctuidae: Heliothinae) Its Biology, Economic Importance and Its Recent Introduction into the Western Hemisphere," Boletin del museo entomológico, 2014, 6(1):18-28, 11 pgs.
Swenson, SJ, et al., "Corn Earworms (*Lepidoptera: noctuidae*) as Pest of Soybean," J. Interg. Pest Mngmt., 2013: 4(2):1-8, 8 pgs.
Tabashnik, B.E., et al., "Defining Terms for Proactive Management of Resistance to Bt Crops and Pesticides," J Econ Entomol, 2014, 107(2):496-507, 12 pgs., PMID: 24772527.
Tabashnik, B.E., et al., "Insect resistance to Bt crops: lessons from the first billion acres," Nat Biotechnol, 2013, 31:510-521, 12 pgs., PMID:23752438.
Tabashnik, B.E., et al., "Field-Evolved Insect Resistance to Bt crops: Definition, Theory, and Data," J Econ Entomol, 2009, 102(6):2011-2025, 15 pgs.
Tretyakova, N.Y., et al., "DNA-Reactive Protein Monoepoxides Induce Cell Death and Mutagenesis in Mammalian Cells," Biochemistry, May 2013, 52(18):3171-3181, 22 pgs., PMID: 23566219.
Tyagi, A., et al., "Bioinformatics analysis of codon usage patterns and influencing factors in Penaeus monodon nudivirus," Arch Virol, 2016, 161(2):459-464, 6 pgs., PMID: 26586333.
Unckless, R.L., "A Dna Virus of *Drosophila*," PLoS One, 2011, 6(10):e26564, 10 pgs., PMID: 22053195.
United States Department of Agriculture (USDA), "Acreage," Jun. 30, 2015, ISSN: 1949-1522, 42 pgs., accessed from www.usda.gov/nass/PUBS/TODAYRPT/acrg0615.pdf.
Walters, M., et al., "Field Longevity of a Fluorescent Protein Marker in an Engineered Strain of the Pink Bollworm, *Pectinophora gossypiella* (Saunders)," PLoS One, 2012, 7(6):e38547, 7 pgs., PMID: 22693645.
Wang, Y., et al., "The genome of Oryctes rhinoceros nudivirus provides novel insight into the evolution of nuclear arthropod—specific large circular double-stranded DNA viruses," Virus Genes, 2011, 42(3):444-456, 14 pgs., PMID: 21380757.
Wang, Y., et al., "Nudiviruses and other large, double-stranded circular DNA viruses of invertebrates: New insights on an old topic," J Invertebr Pathol, 2009, 101(3):187-193, 7 pgs, PMID: 19460388.
Wang, Y., et al., "Sequencing of the large dsDNA genome of Oryctes rhinoceros nudivirus using multiple displacement amplification of nanogram amounts of virus DNA," J Virol Methods, 2008, 152(1-2):106-108, 3 pgs., PMID: 18598718.
Wang, Y., "The Genome of Gryllus bimaculatus nudivirus Indicates an Ancient Diversification of Baculovirus-Related Nonoccluded Nudiviruses of Insects," J Virol, 2007, 81(10):5395-5406, 12 pgs., PMID: 17360757.
Wang, Y., et al., "Genomic analysis of Oryctes rhinoceros virus reveals genetic relatedness to Heliothis zea virus 1," Arch Virol, 2007, 152(3):519-531, 14 pgs., PMID: 17106621.
Wijen, J.P., et al., "Genetic damage by bifunctional agents in repair-active pre-meiotic stages of *Drosophila* males," Mutat Res, 2001, 478:107-117, 11 pgs., PMID: 11406175.
Wood, H.A., et al., "Persistent and productive infections with the Hz-1 baculovirus," Current topics in microbiology and immunology, 1986, 131:119-133, PMID: 3816297, 1 pg.
Wu, Y.L., et al., "The Early Gene hhil Reactivates Heliothis zea Nudivirus 1 in Latently Infected Cells," Journal of Virology, Jan. 2010, 84(2):1057-1065, 9 pgs., PMID: 19889784.
Wu, Y.L., et al., "A Non-coding RNA of Insect HzNV-1 Virus Establishes Latent Viral Infection through MicroRNA," Scientific Reports, 2011, 1:60, 10 pgs., PMID: 22355579.
Wu, Y.L., et al., "Heliothis zea Nudivirus 1 Gene hhil Induces Apoptosis Which is Blocked by the Hz-iap2 Gene and a Noncoding Gene, pag1," Journal of Virology, 2011, 85:6856-6866, 11 pgs., PMID: 21543471.
Wu, Y.L., et al., "Cooperation of ie1 and p35 genes in the activation of baculovirus AcMNPV and HzNV-1 promoters," Virus Res, 2008, 135(2):247-254, 8 pgs., PMID: 18486255.
Yang, Y.T., et al., "The genome and occlusion bodies of marine Penaeus monodon nudivirus (PmNV, also known as MBV and PemoNPV) suggest that it should be assigned to a new *Nudivirus* genus that is distinct from the terrestrial nudiviruses," BMC Genomics, 2014, 15:628, 24 pgs., PMID: 25063321.
Yazaki, K., et al., "A new method for extracting circular and supercoiled genome segments from cytoplasmic polyhedrosis virus," J Virol Methods, 1986, 14(3-4):275-283, 9 pgs., PMID: 3539959.
Zhao, X.-C., et al., "Hybridization between Helicoverpa armigera and Helicoverpa assulta (Lepidoptera: Noctuidae): development and morphological characterization of F1 hybrids," Bulletin of Entomol Research, 2005, 95:409-416, 8 pgs.
Heckel et al. The Diversity of Bt Resistance Genes in Species of *Lepidoptera*. Journal of Invertebrate Pathology, 2007. 95:192-197.
International Search Report and Written Opinion dated Oct. 31, 2016 for Application No. PCT/US2016/032345, 14 pgs.
"Adoption of Genetically Engineered Crops in the United States," United States Department of Agriculture, 1996-2015, 2015 Report, 2 pgs., accessed from: http://www.ers.usda.gov/data-products/adoption-of-genetically-engineered-crops-in-the-us/recent-trends-in-ge-adoption.aspx.
Adamo, S.A., et al., "A viral aphrodisiac in the cricket Gryllus texensis," J Exp Biol., 2014, 217(Pt 11):1970-1976, 7 pgs., PMID: 24625650.
Ali, M.I., et a., "Susceptibility of Bollworm and Tobacco Budworm (*Lepidoptera: noctuidae*) to Cry2Ab2 Insecticidal Protein," J Econ Entomol, 2007, 100:921-931, 11 pgs., PMID: 17598557.
Ali, M.I., et al., "Susceptibilities of Helicoverpa zea and Heliothis virescens (Lepidoptera: Noctuidae) Populations to Cry1Ac Insecticidal Protein," J Econ Entomol, 2006, 99:164-175, 12 pgs., PMID:16573337.
Anderson, D., et al., "Rapid Generation of Recombinant Baculoviruses and Expression of Foreign Genes Using BAC-To-BACTM Baculovirus Expression System," Focus, 1996, 17:53-58, 6 pgs.
Arneodo, J.D., et al., "Molecular identification of Helicoverpa armigera (Lepidoptera: Noctuidae: Heliothinae) in Argentina and Development of a Novel PCR-RFLP Method for its Rapid Differentiation from H. zea and H. gelotopoeon," J Econ Entomol, 2015, 108(6):2505-2510, 6 pgs., PMID: 26318007.

(56) References Cited

OTHER PUBLICATIONS

Bedford, G.O., "Biology and Management of Palm Dynastid Beetles: Recent Advances," Annu Rev Entomol, 2013, 58:353-372, 23 pgs., PubMed PMID: 23317044.
Bergé, J.B., et al., "Emergence of minor pests becoming major pests in GE cotton in China: What are the reasons? What are the alternatives practices to this change of status?" GM Crops, 2010, 1(4): 214-219, 6 pgs., PMID: 21844676.
Bézier, A., et al., "The Genome of the Nucleopolyhedrosis-Causing Virus from Tipula oleracea Sheds New Light on the Nudiviridae Family," J Virol, 2015, 89(6):3008-3025, 18 pgs., PMID: 25540386.
Burand, J.P., "Pathology and Replication of the Sexually Transmitted Insect Virus HzNV-2," Advances in Virus Research, 2013, 20 pgs., ISBN: 978-1477555-04-0, iConcept Press.
Burand, J.P., et al., "Analysis of the Genome of the Sexually Transmitted Insect Virus Helicoverpa zea Nudivirus 2," Viruses, 2012, 4:28-61, 34 pgs, PMID:22355451.
Burand J.P., et al., "Infection with the insect virus Hz-2v alters mating behavior and pheromone production in female *Helicoverpa zea* moths," J Insect Sci, 2005, 5:6, 6 pgs., PMID: 16299596.
Burand, J.P., et al., "In vivo dose-response of insects to Hz-2V infection," Virology Journal, 2004, 1:15, 7 pgs., PMID:15613241.
Burand, J.P., et al., "Horizontal transmission of Hz-2V by virus infected *Helicoverpa zea* moths," J Invertebr Pathol, 2004, 85:128-131, 4 pgs., PMID:15050843.
Burand, J.P., et al., "Replication of a Gonad-Specific Insect Virus in TN-368 Cells in Culture," J Invertebr Pathol, 1997, 70(2):88-95, 8 pgs., PMID: 9281395.
Burand, J.P., et al., "Intracellular Protein Synthesis During Standard and Defective Hz-1 Virus Replication," J Gen Virol, 1986, 67:167-173, 7 pgs.
Burand, J.P., et al., "Structural and Intracellular Proteins of the Nonoccluded Baculovirus HZ-1," J Virol, Apr. 1983, 46(1):137-142, 6 pgs., PMID: 16789238.
Burand, J.P., et al., "Defective Particles from a Persistent Baculovirus Infection in Trichoplusia ni Tissue Culture Cells," J Gen Virol, 1983, 64:391-398, 8 pgs.
Campagne, P., et al., "Dominant Inheritance of Field-Evolved Resistance to Bt Corn in Busseola fusca," PLoS One, 2013, 8:e69675, 7 pgs., PMID:23844262.
Capinera, J.L., Corn Earworm, *Helicoverpa* (=Heliothis) zea (Boddie) (Lepidoptera:Noctuidae), IFAS Extension, University of Florida, 2000, revised Aug. 2007, 6 pgs., accessed from: http://edis.ifas.ufl.edu/in302.
Carriere, Y., et al., "Evolutionary ecology of insect adaptation to Bt crops," Evol Appl, 2010, 3:561-573, 13 pgs.
Chao, Y.C., et al., "A 2.9-Kilobase Noncoding Nuclear RNA Functions in the Establishment of Persistent Hz-1 Viral Infection," J Virol, 1998, 72(3):2233-2245, 13 pgs., PMID: 9499081.
Chao, Y.C., et al., "Differential Expression of Hz-1 Baculovirus Genes during Productive and Persistent Viral Infections," J Virol., Mar. 1992, 66(3):1442-1448, 7 pgs., PMID: 1738201.
Chen, H.H., et al., "Negative regulatory regions of the PAT1 promoter of Hz-1 virus contain GATA elements which associate with cellular factors and regulate promoter activity," J Gen Virol, 2001, 82:313-320, 8 pgs, PMID: 11161268.
Cheng, C.H., et al., "Analysis of the Complete Genome Sequence of the Hz-1 Virus Suggests that It is Related to Members of the Baculoviridae," J Virol, Sep. 2002, 76(18):9024-9034, 11 pgs, PMID: 12186886.
Cheng, R.L., et al., "Brown Planthopper Nudivirus DNA Integrated in its Host Genome," J Virol, May 2014, 88 (10):5310-5318, 9 pgs., PMID: 24574410.
Cunningham, J.P., et al., "Understanding Heliothine (Lepidoptera: Heliothinae) Pests: What is a Host Plant?" J Econ Entomol., 2014, 107(3):881-896, 16 pgs., PMID: 25026644.
De Miranda, J.R., et al., "Venereal and vertical transmission of deformed wing virus in honeybees (*Apis mellifera* L.)," J Invertebr Pathol, 2008, 98(2):184-189, 6 pgs., PubMed PMID: 18358488.
Eberle, K.E., et al., "Microbial Control of Crop Pests using Insect Viruses," Integrated Pest Management: Principles and Practice, 2012, Cabi Publishing, Wallingford, Oxon, UK, 18 pgs.
"The Environmental Protection Agency's White Paper on Bacillus thuringiensis Plant-pesticide Resistance Management," United States Environmental Protection Agency; Prevention, Pesticides and Toxic Substances, 7511W, EPA 739-S-98-001, May 1998, 90 pgs.
Ferrelli, M.L., et al., "Characterization of a new Helicoverpa armigera nucleopolyhedrovirus variant causing epizootic on a previously unreported host, Helicoverpa gelotopoeon (Lepidoptera: Noctuidae)," J Invertebr Pathol., 2015, pii: S0022-2011(15)30008-2, 15 pgs., PMID: 26296927.
Fitt, G.P., "The Ecology of Heliothis Species in Relation to Agrosystems.," Ann Rev Entomol, 1989, 34:17-52, 38 pgs.
Franz, G., et al., "Molecular technologies to improve the effectiveness of the sterile insect technique," Genetica, 2011, 139(1):1-5, 6 pgs., PMID: 21258957.
Gherezghiher, T.B., et al., "1,2,3,4-Diepoxybutane-Induced DNA-Protein Cross-Linking in Human Fibrosarcoma (HT1080) Cells," J Proteome Res., May 2013, 12(5):2151-2164, 27 pgs., PMID: 23506368.
Granados, R.R., et al., "An insect cell line persistently infected with a baculovirus-like particle," Intervirol, 1978, 10(5):309-17, 9 pgs.
Hamm, J.J., "Gonad-Specific Virus of Helicoverpa zea Does Not Affect Infectivity of Nuclear Polyhedrosis Virus," J. Entomol. Sci., 1997, 32(1):106-109, 4 pgs.
Hamm, J.J., et al., "Oviposition Day Effect on Incidence of Agonadal Progeny of Helicoverpa zea (Lepidoptera: Nocutidae) Infected With a Virus," Ann. Entomol. Soc. Am., 1996, 89(2):266-275, 10 pgs.
*Helicoverpa zea* (American cotton bollworm), Datasheet, May 28, 2015, accessed May 19, 2016, from CABI http://www.cabi.org/isc/datasheet/26776, 30 pgs.
"Helicoverpa armigera TWG Report," Rev. 1, USDA APHIS PPQ Technical Working Group, Dec. 2014, 20 pgs.
"Statistics and facts on genetically modified crops," Statista, The Statistics Portal, July 2104, accessed Apr. 10, 2015 from http://www.statista.com/topics/2062/genetically-modified-crops/ , 4 pgs.
Huang, F., et al., "Success of the high dose/refuge resistance management strategy after 15 years of Bt crop use in North America," Entomol Exp Appl, 2011, 140:1-16, 17 pgs.
James, C., "Global Status of Commercialized Biotech/GM Crops: 2012," Internatinal Service for the Acquistion of Agri-Biotech Applications (ISAAA), Brief 44, 2012 (Ithaca, NY: ISAAA), 329 pgs.
Kempf, C., et al., "Semliki Forest Virus Induced Cell-Cell Fusion at Neutral Extracellular pH," Biosci Rep., 1990, 10(4):363-374, 12 pgs., PMID: 2249002.
Kimble, M., et al., "The beta3-Tubulin Gene of *Drosophila melanogaster* is Essential for Viability and Fertility," Genetics, Dec. 1990, 126(4):991-1005, 15 pgs.
Kirkpatrick, B.A., et al., "Primary Infection of Insect Tracheae by Autographa californica M Nuclear Polyhedrosis Virus," Virology, 1994, 2013:184-186, 3 pgs.
Knell, R.J., et al., "Sexually transmitted diseases of insects: distribution, evolution, ecology and host behavior," Biol Rev Camb Philos Soc, 2004, 79(3):557-581, 25 pgs., PMID: 15366763.
Lee, D-H, et al., "Mutations Induced by 1,3-Butadiene Metabolites, Butadiene Diolepoxide, and 1,2,3,4-Diepoxybutane at the Hprt Locus in CHO-K1 Cells," Mol. Cells, 2002, 14(3):411-149, 9 pgs.

* cited by examiner

UTR: Untranslated region, CNS: Conserved non-coding region.

UTR: Untranslated region, CNS: Conserved non-coding region.

UTR: Untranslated region, CNS: Conserved non-coding region.

UTR: Untranslated region, CNS: Conserved non-coding region.

MUTANT NUDIVIRUS INSECT CONTROL

CROSS-REFERENCE TO RELATED APPLICATIONS

This application is a Continuation-in-part application that claims the benefit of and priority to U.S. Ser. No. 16/722,071 filed Dec. 20, 2019, entitled "Compositions and Methods for Pest Control Management"; which is a Continuing application that claims the benefit and priority of U.S. Ser. No. 15/694,323 filed Sep. 1, 2017 entitled "Compositions and Methods for Pest Control Management" now Abandoned, which is a Continuing application that claims benefit and priority to U.S. Ser. No. 15/154,069 filed May 13, 2016 now U.S. Pat. No. 9,770,033 entitled "Compositions and Methods for Pest Control Management"; which claims the benefit and priority to "U.S. Provisional Application Ser. No. 62/161,674, filed on May 14, 2015 entitled "Mutant Nudivirus and Method for Using Same for Insect Control," the contents of which all of the above are incorporated herein in their entirety for all purposes.

REFERENCE TO AN ELECTRONIC SEQUENCE LISTING

The contents of the electronic sequence listing (Sequence Listing—Mutant Nudivirus Insect Control.xml; Size: 902,964 bytes; and Date of Creation: Dec. 14, 2022) is herein incorporated by reference in its entirety.

BACKGROUND

Insect pests cause crop damage worldwide resulting in significant losses to food and fiber crops and increased production costs that target control of such pests. For example, the *heliothine* complex of lepidopteran moths cause in excess of 2 B dollars in damage and cost of control in the United States annually. While all crops are susceptible to similar pest pressure, transgenic expression of *Bacillus thuringiensis* (Bt) toxins was developed to control the lepidopteran pests and has become a major tool for control of these and other insect pests. Since the commercial introduction of Bt crops in 1996, they have been adopted around the world and have been grown on more than one billion acres worldwide. In the US, 81% of corn and 84% of cotton express one or more Bt toxins. (HyperTextTransferProtocol://WorldWideWeb.ers.usda.gov/data-products/adoption-of-genetically-engineered-crops-in-the-us/recent-trends-in-ge-adoption.aspx, 2015 report, wherein "HyperTextTransferProtocol" is "http", and "WorldWideWeb" is "www".) Unfortunately, due to the remarkable ability of insects to adapt to insecticides, resistance to Bt toxins was predicted and reports of field-evolved resistance and reduced efficacy are increasing. Such resistance is a threat to the sustainability of important Bt crops, in the US and elsewhere. Thus, there is a continuing need to develop new methods to control insect pests. For example, *Helicoverpa zea* (*H. zea*, commonly known as the corn earworm), is a major polyphagous moth pest in the *heliothine* complex in the United States and causes millions of dollars of damage to corn and cotton plants each year.

A number of pests in the *heliothine* complex of moths, notably *Helicoverpa armigera* and *Heliothis virescens* are highly polyphagous and cause economically significant damage to many crops. Crops commonly damaged by *H. armigera* and *H. virescens* include cotton, corn, soybean, sunflowers, tomato, sorghum, strawberry, peppers, beans, aubergine, okra, peas, millet, cucumber, melon, lettuce, cauliflower, and cabbage. Because *H. armigera* and *H. virescens* attack a wide variety of plants and, in many instances, are developing resistance to Bt crops, farmers rely heavily on pesticides to control these pest insects.

The need for pest management, such as in field, fruit and vegetable crops, is a need in the art, which will only become more critical as resistance to Bt expands. Further, there is a need for pest management that does not involve the use of conventional pesticides or transgenic technologies such as in organic cropping systems. The instant invention addresses one or more aforementioned needs in the art.

BRIEF SUMMARY

Disclosed are the *H. zea* nudivirus sequence and two additional related sequences from *H. virescens* and *H. armigera* nudiviruses for development of genetically modified universes capable of being sexually transmitted by an insect useful for controlling pest populations. Such genetically modified nudiviruses are capable of causing sterility in a target population of insects. Previously disclosed were insects infected with the previously disclosed genetically modified *H. zea* nudivirus, methods of making genetically modified nudiviruses, and methods of using genetically modified nudiviruses to control an insect pest population.

BRIEF DESCRIPTION OF THE DRAWINGS AND FIGURES

FIG. 1. Schematic of the model *Helicoverpa zea* nudivirus 2 (HzNV-2) genome showing genes known to be involved or implicated in sterilizing mutations.

FIG. 2. Percentage of agonadal female F1 progeny. Wild-type (WT) and mutant HzNV-2 generated by chemical mutagenesis (KS-3, KS-38, KS-39, KS-45, KS-51, and KS-52) were injected into adult female moths on the day of emergence, and eggs were collected on oviposition days 2 (OviD2) and 3 (OviD3). Female F1 progeny were reared to adult moths and evaluated for the presence of a viral plug indicating an agonadal pathology (OviD2-WT n=17, KS-3 n=24, KS-38 n=23, KS-39 n=26, KS-45 n=19, KS-51 n=14, KS-52 n=18; OviD3-WT n=15, KS-3 n=16, KS-38 n=22, KS-39 n=16, KS-45 n=19, KS-51 n=18, KS-52 n=23).

FIG. 3. Occurrence of complete sterility in agonadal female F1 progeny. Wild-type (WT) and mutant HzNV-2 (KS-3, KS-38, KS-39, KS-45, KS-51, and KS-52) were injected into adult female moths on the day of emergence, and offspring eggs were collected on oviposition days 2 (OviD2) and 3 (OviD3). Female F1 progeny were reared to adult moths and evaluated for ability to lay viable eggs. Failure to lay eggs or lay viable eggs indicates complete sterility (OviD2-WT n=17, KS-3 n=24, KS-38 n=23, KS-39 n=26, KS-45 n=19, KS-51 n=14, KS-52 n=18; OviD3-WT n=15, KS-3 n=16, KS-38 n=22, KS-39 n=16, KS-45 n=19, KS-51 n=18, KS-52 n=23). This illustrates that these mutant HzNV-2 causes decreased egg production and sterility.

FIG. 4. Effect of viral titer on *H. zea* egg production. Female adult moths (7) were injected with 100 μl wt HzNV-2 (high dose: $4\times10^4$ pfu/ml; low dose: 40 pfu/ml) or yfp recombinant HzNV-2 (high dose: $1\times10^7$ pfu/ml; low dose: $1\times10^4$ pfu/ml) isolated from cell culture and mated with uninfected male moths (9). Eggs were collected on oviposition days 2-5 and counted. Uninfected females were mated with uninfected males as a control.

FIG. 5. Direct inoculation of insect larvae causes high numbers of agonadal moths. Wild-type (WT) HzNV-2 and mutant KS3 were amplified in Sf9 insect cell culture and injected into third instar larvae via an insulin syringe. WT HzNV-2 and mutant yfp HzNV-2 virus isolated from viral plugs of agonadal female moths were used to infect third instar larvae via a pre-sterilized pin. After both types of infections, larvae were reared to adult moths, and females were examined for the presence of a viral plug, an indicator of virus infection and agonadal pathology (Syringe, WT n=20, KS3 n=25; Pin, WT n=20, yfp HzNV-2 n=21).

FIG. 6. 1.5% agarose gel showing PCR results that yfp HzNV-2 is a pag1 mutant. Wild-type (WT) HzNV-2 (control) and yfp HzNV-2 viral DNA and yfp-pUC57 (control), the plasmid used for homologous recombination to make the yfp HzNV-2 virus, were used as DNA templates in the PCR reactions. If present, yfp primers were used to amplify the yellow fluorescent protein gene (547 bp); pag1 primers were used to amplify pag1 DNA; ORF78 primers were used to amplify hypothetical gene ORF78 (403 bp) that the DNA is from HzNV-2.

FIG. 7 Schematic alignment of HvNV genome with HzNV-2 genome.

FIG. 8. Schematic alignment of HvNV ORF 90 with HzNV-2 ORF 90.

FIG. 9. Schematic alignment of HvNV ORF 92 with HzNV-2 ORF 92.

FIG. 10 Schematic alignment of HaNV with HzNV-2 genome.

FIG. 11. Schematic alignment of HaNV ORF 90 with HzNV-2 ORF 90.

FIG. 12. Schematic alignment of HaNV ORF 92 with HzNV-2 ORF 92.

FIG. 13A-13D. Together show the whole genome alignment of HvNV main contig and HzNV-2 genome.

FIG. 14 Schematic alignment of HvNV pag1 genome with HzNV-2 pag1 genome.

FIG. 15 Schematic alignment of HaNV pag1 genome with HzNV-2 pag1 genome.

BRIEF DESCRIPTION OF SEQUENCE ID'S OF NUDIVIRUS GENOMIC AND AMINO ACID SEQUENCES

Sequences IDI-19. Sequences of *Heliothis zea* nudivirus (HzNV) genome. These sequences were originally filed in U.S. patent application Ser. No. 15/154,069 filed May 13, 2016, now U.S. Pat. No. 9,770,033 issued Sep. 26, 2017, from which the current application depends. Sequences of U.S. Pat. No. 9,770,033 are inserted as required by WIPO ST.26 protocol whereby the sequences of the earliest priority application are disclosed as required.

Sequence ID20. Sequence of *Heliothis virescens* nudivirus (HvNV) genome.

Sequence ID21. Predicted peptide sequence of HvNV ORF 90

Sequence ID22. Predicted peptide sequence of HvNV ORF 92

Sequence ID23. Partial sequence of *Heliothis armigera* (HaNV) genome.

Sequence ID24. Predicted peptide sequence of HaNV ORF 90

Sequence ID25. Predicted peptide sequence of HaNV ORF 92.

Sequence ID26. Sequence of HvNV pag1 nucleotide sequence.

Sequence ID27. Sequence of HaNV pag1 nucleotide sequence.

DETAILED DESCRIPTION

As used herein and in the appended claims, the singular forms "a," "and," and "the" include plural referents unless the context clearly dictates otherwise. Thus, for example, reference to "a method" includes a plurality of such methods and reference to "a dose" includes reference to one or more doses and equivalents thereof known to those skilled in the art, and so forth.

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviations, per the practice in the art. Alternatively, "about" can mean a range of up to 20%, or up to 10%, or up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

The term "closely related" as used herein, with respect to the term insect and/or moth, means a species so closely related so as to support replication of the HzNV-2, HvNV or HaNV viruses.

The terms "express" and "expression" mean allowing or causing the information in a gene or DNA sequence to become manifest, for example producing a protein by activating the cellular functions involved in transcription and translation of a corresponding gene or DNA sequence. A DNA sequence is expressed in or by a cell to form an "expression product" such as a protein. The expression product itself, e.g. the resulting protein, may also be said to be "expressed". An expression product can be characterized as intracellular, extracellular or secreted. The term "intracellular" means something that is inside a cell. The term "extracellular" means something that is outside a cell. A substance is "secreted" by a cell if it appears in significant measure outside the cell, from somewhere on or inside the cell.

The term "gene", also called a "structural gene" means a DNA sequence that codes for or corresponds to a particular sequence of amino acids which comprise all or part of one or more proteins or enzymes and may or may not include introns and regulatory DNA sequences, such as promoter sequences, 5'-untranslated region, or 3'-untranslated region which affect for example the conditions under which the gene is expressed. Some genes, which are not structural genes, may be transcribed from DNA to RNA, but are not translated into an amino acid sequence. Other genes may function as regulators of structural genes or as regulators of DNA transcription.

By "genetically modified" is meant a gene that is altered from its native state. The term "genetically modified," as used herein, includes a sequence (a virus, for example) that contains genetic material from more than one organism. The term further includes a sequence that is modified from its native state, for example, via a deletion or insertion, and which does not include genetic material from more than one organism. The latter may be referred to as a "mutant" as used herein.

The instant disclosure addresses one or more needs in the art as described above. In one aspect, the present disclosure addresses the globally important need for new methods to control insect pests in crops threatened by such pests. In a further aspect, the disclosure addresses an increasingly important issue, Bt resistance, that threatens the sustainability of insect-resistant transgenic crops.

A sexually transmitted insect virus, *Helicoverpa zea* nudivirus 2 (HzNV-2, accession number NC_004156), is known to cause approximately 33% of infected *H. zea* to be sterile. (Raina 1995). Wildtype (WT) HzNV-2, however, is not a potential biological control agent due to the high proportion of asymptomatic carrier moths. Applicant has found that HzNV-2 can be modified so that extremely high percentages, for example, up to 100%, or greater than about 90%, of the infected *H. zea* become sterile (U.S. Pat. No. 9,770,033). This invention describes two novel nudiviruses, the *Heliothis virescens* nudivirus (HvNV) and the *Helicoverpa armigera* nudivirus (HaNV) that enable genetic modification as described in the patent application U.S. Ser. No. 16/722,071 and U.S. Ser. No. 15/154,069 directed to HzNV-2 to which this invention claims priority. In these priority applications, HzNV-2 is shown to be an important tool in controlling various insect pests by causing collapse in the target insect population. As such, these two-novel mutant nudiviruses, HvNV and HaNV, may be an important tool in controlling various insect pests by causing collapse in the target insect population. In turn, this modified virus can be used to infect a target insect and control an insect population without the use of traditional pesticides, or, alternatively, can be used in combination with traditional pesticides such that the amount of the pesticide used is minimized. Such a technology may have utility in control of populations of Bt resistant insects and invasive insect populations for which traditional pesticides are ineffective. Applicant's approach allows for pest control via release of insects infected with a sexually transmitted virus that can be transmitted by mating in the targeted farming area. The approach developed by Applicant is effective for both transgenic and/or non-transgenic crops and can target pest species in which the virus replicates and is sexually transmitted.

Attempts to control insect populations via genetic manipulation of crops is currently limited due to the ability of insects to rapidly develop resistance to the genetically added toxins and is further limited by the costs to producers to use such modified crops. For example, crops expressing the *Bacillus thuringiensis* (Bt) toxins were introduced twenty years ago to control caterpillar pests. Since then, they have been adopted worldwide, planted on more than one billion acres, and have become one of the most successful and rapidly adopted agricultural technologies since the 'green revolution' of the mid-20th century (James, 2012). As of 2015 in the US, 81% of corn and 84% of cotton express one or more Bt toxins. However, the widespread adoption of Bt technology carries the significant risk that overuse will inevitably lead to development of insect resistance to Bt toxins and crop failures, which threatens the technology's continued viability (Carriere et al., 2010, Tabashnik et al., 2013; Tabashnik et al., 2009). This risk, which always has been recognized by regulators, industry, and researchers, has been managed by resistance monitoring and the use of refuge strategies to delay resistance. These refuge strategies, which have been mandated by the EPA in the USA with similar mandates in other countries, entail the planting of nearby non-transgenic plants to maintain susceptible insect populations (EPA, 1998; Huang et al., 2011). Unfortunately, this practice is not always followed due to cost to producers and is not always effective because of the remarkable ability of insects to evolve resistance to insecticides. Increasing insect resistance to Bt plants is reported, and some insects exhibit resistance traits that are genetically dominant (Campagne et al., 2013). To summarize, Bt-resistant insects represent an ongoing and increasingly important threat to the continued efficacy of Bt crops, and to food and fiber production in the US and worldwide.

One insect pest threatening Bt crops is the corn earworm, *Helicoverpa zea*, a lepidopteran moth. *H. zea* is found throughout North America, for example, where it is the second most costly crop pest (Fitt, 1989), and is also found in Central America, the Caribbean, and South America. *H. zea*, which feeds on many different plants and has several common names (e.g., corn earworm, cotton budworm, tomato fruitworm) has some strains that are 1000-times more resistant to Bt toxin than susceptible insects (Ali and Luttrell, 2007; Ali et al., 2006).

Applicant has developed a new approach to suppress insect pest populations. In a further aspect, Applicant has developed a new approach to managing Bt resistance, which relies upon engineering or mutating a sexually transmitted insect virus that sterilizes infected insects (including complete or partial sterility). Insects containing the mutant virus may be released in areas where Bt resistance is present in *H. zea* populations, thereby suppressing these targeted populations and preserving the utility of the Bt transgenic plants and/or non-transgenic plants. Similarly, the susceptible pest insects are commonly invasive across the world and the disclosed methods may be used to reduce and eliminate the invasive insect pest populations. The viruses developed by Applicant are mutant and recombinant forms of a naturally occurring (i.e., wild-type) virus, *Helicoverpa zea* nudivirus 2 (HzNV-2), which infects *H. zea*. HzNV-2 was previously the only lepidopteran insect virus which has been shown to be sexually transmitted and causes sterility in both male and female moths. In one aspect, the infected insect may have partial sterility, defined as when a female *H. zea* moth lays less than 30 viable eggs each day due to damage to her reproductive organs. In one aspect, the infected insect may have complete sterility, defined as the inability of a female moth to lay viable eggs due to damage to her reproductive organs.

In one aspect, disclosed is a genetically modified nudivirus of a wild type nudivirus for HzNV-2, HvNV and HaNV. The genetically modified nudivirus contemplated herein is generally capable of being sexually transmitted by an insect and capable of causing sterility in an insect at a rate of greater than about 50%, or from about 50% to about 100%, or from about 80% to about 95% or from about 90% to about 100% following infection of said insect with said nudivirus comprising a genetic mutation.

In one aspect, the wild type nudivirus has at least about 80% sequence identity to *Helicoverpa zea* nudivirus 2 (HzNV-2) virus. The wild type nudivirus may be characterized in that it has a latent phase, has about 80% or greater sequence identity to *Helicoverpa zea* nudivirus 2 (HzNV-2, also known as *Heliothis zea* nudivirus or gonad specific virus) virus, and is capable of replicating in one or more moths.

In one aspect, the genetically modified nudivirus HzNV-2 and related nudivirus for HzNV-2, HvNV and HaNV may contain a disruption in a latent phase of said wild type nudivirus.

In one aspect, the insect may be a lepidopteran moth in the family noctuidae which supports replication of the HzNV-2 virus in reproductive tissues sufficient to cause sterility at a rate of 50% or greater. The insect may be selected from *Helicoverpa zea* (*H. zea*) *H. armigera, Heliothis virescens, H. assulta, Agrotis ipsilon, Spodoptera frugiperda, Spodoptera exiguae*, closely related moths, noctuid moths, or combinations thereof.

In one aspect, genetic modification may be a mutation in one or more genes selected from the HzNV-2 persistence-associated gene (pag1) (which encodes PAT1, or the persistence associated transcript (SEQ ID NO: 7)), ORF 90 (SEQ ID NO: 4), ORF92 (SEQ ID NO: 5), ORF 2 (SEQ ID NO: 3), or combinations thereof, such that the modification is sufficient to disrupt expression of one or more of such genes, for example, wherein said disruption reduces expression or is a functional knockout. In one aspect, the genetic modification may be a mutation in the HzNV-2 persistence associated gene (pag1) sufficient to disrupt expression of the pag1 gene. In one aspect, the genetic modification may be a mutation in the HzNV-2 pag1 gene (SEQ ID NO: 7), which is the persistently associated transcript and has been shown to be involved in the establishment of latent infections of HzNV-1. In one aspect, the genetic modification may be a mutation in one or more sequences selected from HzNV-2 dr1 (atgaagctgaggatgaatctgaac, SEQ ID NO: 14), dr2 (gaaactcctaaatcaaaggatgaacctaaagcaaag, SEQ ID NO: 15), dr3 (atgaaaaagcaaaggctgaggcgaaggctaaagccgatgctgctgcaaaagccaaagctg, SEQ ID NO: 16), dr4 (ttataccagagagcaagccagaaa, SEQ ID NO: 17), dr5 (acctaaagttgaatctaaagtagt ggaaccacctaaagcggaatctaa aacagtggaagctcctactaaaacagttgaagt, SEQ ID NO: 18), dr6 (agctgccgctaaacgcaaagccgaggctga, SEQ ID NO: 19), or a combination thereof. In one aspect, the genetic modification may be a mutation in HzVN-2 dr3 (SEQ ID NO: 16), for example, KS-3 in which there is a bp insertion at 175,550 and KS-45, 80 bp insertion at 175,650. In one aspect, the genetic modification may be a mutation in HzNV-2 dr6 (SEQ ID NO: 19), for example, KS-51, having a 29 bp deletion at 180,270-180, 299.

While the direct repeat sequences disclosed here in the HvNV or HaNV nudivirus genomes are not identical to HzNV-2, similar structural repeats in baculovirus genomes may vary in nucleotide sequence or number but retain functionality for regulating viral gene expression or viral DNA replication. An example of such repeats are the homologous repeats of *Autograph californica* nucleopolyhedrosis virus and insertion of transposable elements that vary in sequence but alter baculovirus gene expression and replication. Similar functional roles for nudivirus repetitive sequences would be expected by one of ordinary skill in art in view of references such as, for example: Carstens E B, Wu Y. No single homologous repeat region is essential for DNA replication of the baculovirus *Autographa californica* multiple nucleopolyhedrovirus. J Gen Virol. 2007 January; 88(Pt 1):114-122. doi: 10.1099/vir.0.82384-0. PMID: 17170443; and Blissard G W, Rohrmann G F. Baculovirus diversity and molecular biology. Annu Rev Entomol. 1990; 35:127-55, doi: 10.1146/annurev.en.35.010190.001015. PMID: 2154158.

In a further aspect, the genetic modification is one in which an increase in activity of a viral regulatory gene results from the modification, wherein said viral regulatory gene is HzNV-2 hhi-1 (SEQ ID NO: 6). In certain aspects, the identification of a genetic modification of interest can be determined via detection of increased hhi-1 activity.

In one aspect, the genetically modified nudivirus, may be obtained via chemical mutagenesis. In another aspect, the genetically modified nudivirus may be obtained via recombinant DNA technology. Exemplary, non-limiting methods are disclosed herein. In a further aspect, the genetically modified nudivirus may be obtained using gene editing technology as is known in the art.

In one aspect, a method of reducing a population of lepidopteran moths is disclosed. The method may comprise the step of introducing an insect infected with a genetically modified nudivirus as disclosed herein into the population of interest. In one aspect, infected insects of a single sex may be introduced into a target population, for example an all-male or all-female population of insects. In another aspect, a mixed sex population of infected insects may be introduced.

In one aspect, an insect infected with a virus as described above is disclosed. The insect may be a lepidopteran moth. In further aspects, the insect may be *Helicoverpa zea* (*H. zea*) *H. armigera, H. assulta, Heliothis virescens, Agrotis ipsilon, Spodoptera frugiperda, Spodoptera exiguae* or a closely-related moth, or noctuid moths. The insect may be a female or a male.

In one aspect, a method of making an insect capable of transmitting a genetically modified nudivirus as disclosed herein to a population of insects is disclosed. The method may comprise the step of infecting an insect with a genetically modified nudivirus as described herein. In one aspect, the insect is a lepidopteran moth. The insect may be *Helicoverpa zea* (*H. zea*) *H. armigera, H. assulta, Heliothis virescens, Agrotis ipsilon, Spodoptera frugiperda, Spodoptera exiguae* or a closely related moth or noctuid moth. The method may utilize male insects, female insects, or both. In one aspect, the genetically modified nudivirus may be derived from a viral plug. The genetically modified nudivirus may be administered orally to the insect. In other aspects, the genetically modified nudivirus may be administered to an insect via direct inoculation of insect larvae or adult moths by puncturing the cuticle of the insect with a pin containing viral inoculum derived from a viral plug. In a further aspect, the genetically modified nudivirus may be administered to the insect via direct hypodermic injection into third instar larvae or moths.

In one aspect a closely related moth is functionally defined as those which support virus replication and exhibit reproductive tract pathology when infected by HzNV-2, HvNV or HaNV.

In one aspect, a method of protecting a crop susceptible to a moth pest from moth pest damage is disclosed. In this aspect, the method may comprise the step of introducing insects infected with a genetically modified nudivirus as described herein, into a crop of interest. The crop may be any crop threatened by the pest, and may include, for example, the following non-limiting list of crops: corn, cotton, soybeans, tomatoes, sorghum, artichoke, asparagus, cabbage, cantaloupe, collard, cowpea, cucumber, eggplant, lettuce, lima bean, melon, okra, pea, pepper, potato, pumpkin, snap bean, spinach, squash, sweet potato, and watermelon, alfalfa, clover, cotton, flax, oat, millet, rice, sorghum, soybean, sugarcane, sunflower, tobacco, vetch, and wheat, avocado, grape, peaches, pear, plum, raspberry, strawberry, carnation, geranium, gladiolus, nasturtium, rose, snapdragon, zinnia, and combinations thereof. (see HyperText-TransferProtocol://edis.ifas.ufl.edu/in302, wherein "Hyper-TextTransferProtocol" is "http") In certain aspects, the crop may be a *Bacillus thuringiensis* (Bt) toxin producing crop. The insect used may be any insect as described above.

In a further aspect, a method of sterilizing an insect population is disclosed. The method may include the step of introducing a genetically modified nudivirus as described herein into a target insect population. This may include an invasive insect population, and may further include an insect population that is Bt resistant. One such example insect is the lepidopteran moth, which may further include *Helicoverpa zea* (*H. zea*), *H. armigera, H. assulta, Heliothis virescens, Agrotis ipsilon, Spodoptera frugiperda, Spodoptera exiguae* and closely related moths or noctuid moths.

In one aspect, a method of making a genetically modified nudivirus via chemical modification is disclosed. The method may comprise the steps of a) incubating a population of insect cells infected with a virus with about 0.05 mM to about 0.1 mM 1,3-butadiene diepoxide (or 1,2,3,4-Diepoxybutane or "DEB") for at least 1 hour and up to five hours at a temperature range of about 26 to about 28° C., wherein the population of infected insect cells may comprise an Sf9 insect cell, for example, further wherein the insect cell may be infected with a virus having at least 80% identity, or at least 85% identity, or at least 90% identity, or at least 95% identity, or at least 99% identity to a wild-type HzNV-2 virus (SEQ ID NO: 1), and wherein the incubation is sufficient to induce one or more mutations in the HzNV-2 virus;
b) purifying the virus, wherein the purifying step includes the steps of
i. culturing the population of insect cells infected with a virus in a DEB-free media, wherein the population of infected insect cells are isolated and washed prior to the culturing step;
ii. collecting a supernatant from DEB-free media to obtain a DEB-exposed virus population;
c) amplifying and collecting the mutated virus from the DEB-exposed virus population, wherein the collection step may comprise selecting virus from a plaque having a large plaque phenotype.

Exemplary methods making a genetically modified nudivirus via chemical modification are provided below.

EXAMPLES

The present invention may be understood more readily by reference to the following detailed description of preferred embodiments of the invention and the Examples included therein and to the Figures and their previous and following description. Although any methods and materials similar or equivalent to those described herein can be used in the practice or testing of the present invention, the preferred methods, devices, and materials are now described. All references, publications, patents, patent applications, and commercial materials mentioned herein are incorporated herein by reference for the purpose of describing and disclosing the materials and/or methodologies which are reported in the publications which might be used in connection with the invention. Nothing herein is to be construed as an admission that the invention is not entitled to antedate such disclosure by virtue of prior invention.

Method—Generating a Recombinant HzNV-2 Virus

To generate a yfp insert mutant virus using recombinant DNA technology, Applicant replaced the pag1 gene with a gene encoding yellow fluorescent protein (yfp) by homologous recombination. pag1 expresses a microRNA that suppresses the expression of the viral transcription factor, hhi-1, an RNA intermediate necessary to maintain latency in HzNV-1 (Chao, 1998; Wu and Wu, 2011). To inactivate the pag1 gene, a pUC57-based transfer vector, yfp-pUC57, was designed and synthesized with the yfp gene controlled by the *Orgyia pseudotsugata* multicapsid nuclear polyhedrosis virus immediate early 2 (OpIE2) promoter, and flanked by 1.2 kb of viral HzNV-2 sequences upstream and downstream of pag1.

The yfp HzNV-2 recombinant virus was generated by homologous recombination of yfp/pag1-pUC57 plasmid with WT HzNV-2 genomic DNA after transfection into Sf9 insect cells. The mutant virus was plaque purified, screened for YFP fluorescence using a Zeiss observer A1 fluorescent microscope and the AxioVision Rel. 4.6 program, and amplified in Sf9 cells in nudivirus media (1× Supplemented Grace's Media, 7% FBS, 1% Penicillin/streptomycin) in 25 $cm^2$ tissue culture flasks. Viral DNA was isolated from the cell culture supernatant using DNAzol (ThermoFisher Scientific #10503027) and PCR was performed using the AmpliTaq Gold master mix (ThermoFisher Scientific #4398881). PCR results confirmed deletion of pag1 and presence of the yfp gene using internal pag1 (F 5'-GTGGTGCCAGACTTTCAGACATCAT-3' (SEQ ID NO: 10), R 5'-GGGTCTGTTGCGACCTAAAGGTCTA (SEQ ID NO: 11)) and yfp (F 5'-CGAAGAGCTCTT-CACTGGCGTGGT-3' (SEQ ID NO: 12), R 5'-GGTGTTTTGCTGGTAATGATCCGC-3' (SEQ ID NO: 13)) primers, respectively (FIG. 6). Subsequent PCR reactions detected pag1 DNA indicating that the yfp HzNV-2 virus is a yfp, insertional mutant rather than a complete replacement of this gene. Nevertheless, inactivation of pag1 was sufficient to produce a virus that caused sterility in up to 100% of infected insects. Primers to the HzNV-2 open-reading frame ORF78 (F 5'-GCACACCTATCGATCAC-CAT-3' (SEQ ID NO: 1 positions 152572 to 152591), R 5'-GCACGATTCGTAATGTTCAAGG-3' (SEQ ID NO: 2 positions 81062 to 81083)) were used as a control for detecting the HzNv-2 genome.

Method of Targeting Mutations in a Nudivirus Genome

Applicant has developed a novel method using diepoxybutane (DEB) to produce deletions in nudivirus genomes by chemical mutagenesis. DEB is known to crosslink DNA and lead to deletions of multiple bases (from ~50 bases to several kilobases), often within a single gene (Reardon et al., 1987; Wijen et al., 2001). DEB tends to cause mutations within regions of DNA that are actively transcribed. However, published protocols for DEB mutagenesis do not teach mutating a nudivirus as it infects an insect cell so that genes involved in establishing viral lysogeny are preferentially mutated. In the literature, DEB mutagenesis usually involves feeding DEB to insects (Reardon et al., 1987, Genetics 115:323-331; Kimble et al., 1990 Genetics. 1990 December; 126(4):991-1005; Olsen and Green 1982 *Mutat Res.* 1982 Feb. 22; 92(1-2):107-15), or exposing DNA directly to the mutagen (Yazaki et al., J Virol Methods. 1986 November; 14(3-4):275-83). See also Gherezghiher et al. (J Proteome Res 2013, 12(5):2151-2164), Kempf et al. (Biosci Rep 1990 10(4):363-374), "Methods of identifying anti-viral agents" U.S. Pat. No. 7,476,499), which relate to chemical mutagenesis, but which do not describe methods for targeting viral mutations to selective classes of viral genes as disclosed herein. The art does not teach the use of DEB to mutate nudivirus genomes during an infection or methods to target viral genes by synchronizing chemical exposure with stages of the virus infection process in cells. Disclosed herein is a novel method that addresses one or more of the following objectives: 1) efficient mutation in early expressed genes in the HzNV-2 genome, 2) introducing a mutation while avoiding viral DNA damage to a level that compromises virus replication, 3) introducing a mutation while avoiding killing the virus-infected host Sf9 insect cell, and 4) allowing recovery of virus mutants before host cells lyse and the virus becomes unstable (typically in less than 48 h).

Applicant established an efficient protocol, wherein Sf9 cells were infected with WT HzNV-2 at a multiplicity of infection (MOI) of 1 for 1.5 hrs. The 1.5 hr incubation time was chosen because previous literature illustrated that 2 h was enough time for the related HzNV-1 virus (SEQ ID NO: 2) to enter Sf21 insect cells and to transcribe the pag1 gene (Chao et al., 1992. J Virol 66(3):1442-1448). Applicant found that one barrier to an effective method was allowing sufficient time for the virus to enter into the target cell (the insect cell) and start viral transcription. Without intending to be limited by theory, Applicant found that about 1.5 hours was sufficient to achieve this objective. In other aspects, the infection time may be about 45 minutes or more, or about one hour to about two hours. Following this step, 0.1 mM DEB is added to the culture. Applicant found that, at higher concentrations of DEB (equal to and greater than about 0.5 mM), the host cell (for example, Sf9 cells) could not survive. A range of from about 0.05 mM to about 0.1 mM DEB is considered sufficient to carry out the protocol. The cells were harvested by centrifugation after a three hr incubation and re-suspended in fresh medium. Applicant found that three hours was sufficient to cause mutagenesis but not kill host insect cells. In other aspects, the infection time may be about four to five hours.

Plaque assays are performed to isolate mutated viruses, which are then amplified in Sf9 cells and evaluated for cell lysis. A mutation in a locus required for the virus latent phase, such as the pag1 region, should result in increased cell lysis because infected cells do not enter a latent phase. Increased lysis of virus-infected cells could be evident from observations of viral plaque morphology in which lytic virus mutants were larger than wild type virus plaques. Following the protocol, Applicant found that almost half of DEB-treated viral plaques (26 of 66) had a large plaque phenotype. The plaques may be preserved as DEB-mutant HzNV-2 viral stocks. 31 DEB-treated viruses were further screened to determine if they caused agonadal female moths. Briefly, $3^{rd}$ instar larvae were inoculated with a pre-sterilized pin dipped in mutant viral supernatants collected from cell culture. Larvae were reared to adults, and female moths were evaluated for the ability to lay eggs and for the presence of a viral plug. Applicant found that 11 of the 31 mutants (KS-3, KS-38, KS-39, KS-40, KS-45, KS-49, KS-50, KS-51, KS-54, KS-57, KS-65) caused a higher percentage of agonadal females than WT virus and one virus (KS-52) led to lower egg production. The outcome of the DEB mutagenesis was surprisingly efficient; 36% of the 30 viruses caused more agonadal females than the WT virus in the in vivo screen. Random mutation of the HzNV-2 genome would be expected to rarely affect latency because only two of more than 113 viral genes are known to have a role in establishing the latency. In the described method, however, approximately ⅓ of mutants appeared to alter or eliminate the latent phase.

A detailed exemplary method is as follows:

Culture conditions. Seed Sf9 insect cells at $2.5\times10^6$ cells/ml in 2 mL with nudivirus media (1× Supplemented Grace's Media, 7% FBS, 1% Penicillin/streptomycin) in a 25 $cm^2$ tissue culture flask. Then 3 mL wild-type HzNV-2 virus previously amplified in tissue culture at an estimated MOI of 1 is added.

WT HzNV-2 virus was amplified by first seeding Sf9 insect cells in all wells of a 6-well culture dish at $8\times10^5$ cells/ml in 2 ml nudivirus media. After a 1 hr incubation at 27° C., 50 μl of filtered WT HzNV-2 obtained from a viral plug of agonadal female moth (acquired the same day) was added to each well using a large bore tip. Plates were incubated for 2 days at 27° C. Viral supernatants were then collected, cells and debris were removed by centrifugation (900×g, 10 min, 4° C.), and supernatants from all wells were filter sterilized using a 0.22 μm filter and combined. The approximate viral titer from the procedure is $1.5\times10^6$ pfu/ml.

To isolate the WT HzNV-2 from infected female moths, the viral plug from an infected female moth is first extracted from the body and moved to a 1.5 ml-microcentrifuge tube. 100 μl 1×PBS is added and the plug is homogenized manually with a pipette tip to release the virus. The large fragments of insect cuticle and tissue are then removed. This viral solution is termed unfiltered viral plug extract (UVPE). The filtered viral plug extract (FVPE) is a filtered solution (with a 0.22 μm filter) of 1× supplemented Grace's media, 2% unfiltered viral plug extract, and 5% penicillin/streptomycin antibiotics.

Controls for this mutagenesis are performed in parallel. Controls included uninfected Sf9 culture, uninfected S19 culture treated with DEB, and virus-infected S19 culture. These cultures are prepared the same way and at the same time as the mutagenized culture described herein.

The infected Sf9 insect culture is incubated at 27° C. for 1.5 hours.

Chemical Mutagenesis

In a fume hood, DEB (other names 1,3-butadiene diepoxide or 1,2,3,4-Diepoxybutane) is added at a 0.1 mM final concentration to the culture. The culture is then incubated at 27° C. for 3 hours.

After the 3 h incubation, the culture is moved to the fume hood. A cell scraper is used to detach cells from the 25 $cm^2$ flask. The cells and supernatant are moved to a 50 ml-conical tube and centrifuged at 900×g for 10 min at 4° C. The supernatant is removed to a specified waste container. Cells are washed with 10 ml PBS, incubated in fume hood for 5 min, then spun down at 900× g for 10 min at 4° C.

The wash supernatant is removed to a specified waste container. The cell pellet is then resuspended in 5 ml nudivirus media and moved to a new 25 $cm^2$ tissue culture flask, which is now considered DEB-free. Culture is incubated at 27° C. for 2 d.

After 2 days, the cell culture medium containing DEB-exposed HzNV-2 is collected after culture centrifugation at 900×g for 10 min and filter sterilization using a 0.22 μm filter. 2 ml of the virus stock is added to a new 25 $cm^2$ tissue culture flask containing 519 insect cells that were seeded at $1\times10^6$ cells/ml in a 5 ml total volume with nudivirus media. The virus-infected culture is incubated at 27° C. for 7 d.

To purify and amplify the virus to a suitable volume for insect infection, the virus-containing medium was collected after centrifugation (3000 rpm, 10 min, 4° C.), filter sterilized using a 0.22 μm filter, and stored in 1 mL aliquots at −80° C. The titer of the virus is approximately $1\times10^4$ pfu/mL While HzNV-2 has been shown to infect several lepidopteran cell lines including Sf-9 and TN-368 cells, Applicant found that it is difficult to pass the virus in insect cells due to the virus causing quick cellular lysis. The disclosed methods allow for amplification of the virus to a volume that allows for both amounts sufficient virus for storage and also virus suitable for insect infection.

Viruses were isolated using a traditional plaque assay, described in, for example, Anderson, D., Harris, R., Polayes, D., Ciccarone, V., Donahue, R., Gerard, G., and Jessee, J. (1996) Rapid Generation of Recombinant Baculoviruses and Expression of Foreign Genes Using the Bac-To-Bac® Baculovirus Expression System. Focus 17, 53-58. Large plaques, referred to as the p0 viruses, were further amplified.

For p0 to p1 amplification, Sf9 insect cells were seeded at $5\times10^5$ cells/ml in a final 2 ml volume with nudivirus media in 12-well culture plates and incubated at 27° C. for 1 h. Afterwards, viral plaques were picked using a large bore pipette tip and transferred to one well. Plates were incubated at 27° C. for 5 d. Medium containing DEB-treated HzNV-2 virus is collected after culture centrifugation (900×g for 10 m at 4° C.) and filter sterilized using a 0.22 μm filter.

For p1 to p2 amplification, Sf9 insect cells were seeded at $8\times10^5$ cells/ml in a final 2 ml volume with nudivirus media in 6-well culture plates and incubated at 27° C. for 1 h. Afterwards, 600 μl p1 virus was added to one well using a serological pipet. Plates were incubated at 27° C. for 4 d. Medium containing DEB-mutated HzNV-2 was then collected after culture centrifugation (900×g for 10 m at 4° C.).

For p2 to p3 amplification, Sf9 insect cells were seeded at $1\times10^6$ cells/ml in 5 ml with nudivirus media in 25 $cm^2$ tissue culture flask with no incubation. ~1.5 ml (or all) p2 virus was added to one flask using a serological pipet. Flasks were incubated at 27° C. for 4 d. Medium containing DEB-mutated HzNV-2 is then collected after culture centrifugation (900×g for 10 min at 4° C.) and filter sterilization using a 0.22 μm filter. p3 virus is stored in 1 ml aliquots at −80° C.

p3 virus was used to infect $3^{rd}$ instar larvae via the direct inoculation method. Each mutant virus caused an infection in the insect leading to formation of a viral plug found in agonadal female moths. Virus from these viral plugs may be used in subsequent experiments.

Confirming Sterilizing Activity of Recombinant and Chemically Mutated HzNV-2 Virus Taken together, the data demonstrate that recombinant and mutant HzNV-2 viruses can be effectively achieved using one or more of the above-described methods. Recombinant and mutant HzNV-2 viruses having a disrupted latency phase may be produced in which genes that affect the latency phase are disrupted or structural genetic elements required to establish or break latency are altered. The resulting genetically modified mutant HzNV-2 viruses cause elevated levels of sterility in infected *H. zea* moths. In one aspect, the genes that are disrupted include one or more of pag1, ORF 90, and ORF92. It is noted that 100% sterile phenotypes may be produced by mutating different viral genes and regions of the viral genome.

TABLE 1

Locations of mutations in the chemical mutants relative to HzNV-2. Wild-type (WT) HzNV-2 virus was mutated with DEB to form HzNV-2 chemical mutants. Mutants KS-3, KS-45, and KS-51 were sequenced and gene deletions were identified. It is notable that the three mutants have mutations in a region that is not present in the HzNV-1 genome.

| HzNV-2 strain | WT base pairs affected | WT genes affected |
|---|---|---|
| KS-3 | 48 bp insertion at bp 175,550 | ORF90, hypothetical protein |
| KS-45 | 80 bp insertion at bp 175,650 | ORF90, hypothetical protein |
| KS-51 | 180,270-180,299 deletion<br>77 bp insertion at bp 109,598 | ORF92, hypothetical protein<br>Intergenic DNA between hypothetical proteins ORF55 and ORF56 |

The sterilizing activity of the resulting mutants were assessed through many experiments in which virus was injected into *H. zea* adults or 3rd instar larvae. In a typical experiment, WT HzNV-2, the recombinant yfp HzNV-2, and mutant KS3 viruses were collected and purified from viral plugs found in virus-infected female moths and then injected into new healthy female moths 2 days after emergence. The eggs laid on oviposition day 3 were collected and the F1 progeny female adults were analyzed for sterility as indicated by the presence of a viral plug and number of eggs laid (Table 2). Both female groups infected with mutants yfp HzNV-2 and KS-3 laid few or no eggs and had a much higher percentage of agonadal females than the WT-infected group. Thus, the viruses obtained using the described methods are suited for use in sterilizing populations of pests susceptible to infection by the described viruses and may be utilized to control pest populations.

TABLE 2

Injection of female moths with mutant HzNV-2 KS3, recombinant mutant yfp HzNV-2, or wild-type (WT) HzNV-2 and analyses of their female offspring for sterility as determined by the presence of a viral plug and production of eggs.

| Virus | Plugs | Eggs laid |
|---|---|---|
| WT HzNV-2 | 34% | many |
| KS3 | 95% | a few |
| yfp HzNV-2 | 100% | none |

In a similar experiment, WT and 9 chemical mutant viruses were evaluated for the ability to cause agonadal moths. Briefly, adult female moths were injected with 100 μl of $\sim10^8$ pfu/ml of virus isolated from viral plugs on the day of emergence. Eggs laid on oviposition days 2 and 3 were collected and reared to adult moths. The F1 progeny female moths were evaluated for the ability to lay eggs and the presence of a viral plug. Four mutants (KS-3, KS-45, KS-52, KS-51) caused viral plug formation in 100% of the F1 female progeny (FIG. 2). No eggs were laid by F1 female progeny of female moths infected with the three mutants (indicative of an agonadal phenotype (KS3, KS45, KS51) (FIG. 3). F1 female progeny of female moths infected with another mutant KS52, laid fewer eggs than F1 female progeny of female moths infected with WT virus on oviposition day 2 and no eggs on oviposition day 3.

The functional mutations defined by the applicant in ORFs 90 and 92 of HzNV-2 have several unrelated direct repeated sequences ranging from 24 to 81 bp in size and having these sequence repeated from 4 to 12 times. These repeated sequences were identified by Burand et al., (2012). Such repeated sequences may have structural as well as coding roles and with some functions of repeated sequences involving recognition sites for DNA-binding proteins and directing conformational changes of DNA that can promote DNA replication, DNA recombination and/or RNA transcription as examples. A similar repeated sequence exists in ORF 2 (direct repeat 1; Table 2; Burand et al., 2012) and is claimed herein as an identified sequence, region and ORF that is susceptible to mutation and such mutations are likely to impact DNA replication and recombination and the function of the virus relative to its effects on viral lysogeny and increased sterility among *H. zea* infected with mutations that alter ORF2 (SEQ ID NO: 3). It is notable that 3 mutations that increase sterility have been defined by the applicant and localize to ORFs 90 and 92 which contain 4 of the 6 repeated sequences in the HzNV-2 genome. ORF 2 and ORF 91 contain the only other large repeated sequences in the viral genome and are thus obvious candidates for mutagenesis with an expectation that it would impact HzNV-2 replication and lysogeny.

Table 2 shows additional data that compares genetically engineered and chemical mutant viruses. Progeny female moths developing from female moths infected with the genetically engineered recombinant virus, yfp HzNV-2 did not lay eggs and all F1 female progeny had viral plugs indicating their sterility. Similarly, essentially all F1 progeny of female moths infected with the chemical mutant viruses KS3, KS45, KS51, and KS52 had viral plugs and exhibited sterility (Table 2, FIGS. 2 and 3). By contrast, much smaller percentages (~33%) of insects infected with WT virus were agonadal (had plugs) with most moths infected with the WT HzNV-2 being fertile and laying many eggs (Table 2, FIG. 3). Similar results are seen on other oviposition days, although the number of female sterile moths in the F1 progeny of female moths injected with WT HzNV-2 increases at later oviposition days as reported in the literature (Hamm et al., 1996; Burand 2013). These results support the hypothesis that inactivation of several nudivirus genes, for example, pag1 (SEQ ID NO: 6), ORF90 (SEQ ID NO: 4), and ORF92 (SEQ ID NO: 5) can cause sterility in essentially 100% of infected insects.

While it is to be recognized that viruses capable of being sexually transmitted among an insect pest species, can be mutated and selected using the described protocols without knowledge of specific genes involved in the phenotype of the resulting virus (for example, using the DEB protocol described above), some genes associated with increased sterility following viral infection have been identified by the Applicant. For example, the pag1, ORF 90, and ORF92 genes have been found by Applicant to be associated with increased sterility in virus-infected insects.

Infection of an Insect Using Genetically Modified, Hyper-sterilizing Nudiviruses.

Published nudivirus literature describes various techniques for infecting and sterilizing *H. zea* moths with WT HzNV-2 but are lacking in various aspects such that a meaningful protocol can be carried out. Applicant has developed protocols that efficiently 1) infect the adult moth, 2) infect the moth offspring, and 3) mimic natural infections of moth populations in the field.

Method of Sterilizing the Offspring of Adult Moths. A Protocol for Producing Agonadal Infections with WT Sterilizing Nudiviruses.

To infect adult moths, the virus is injected into the abdomen of adult moths using an insulin syringe. In such experiments, WT virus collected from a viral plug effectively infected female adult moths and F1 progeny mimicking natural infected moth populations (i.e. 20-50% agonadal) (Table 3). Virus is collected by removing the plug from the abdominal area and suspending the plug in 100 μl PBS; this is called the unfiltered viral plug extract (UVPE). The virus is then diluted to 2% in 1× Grace's media and filtered through a 0.22 micron filter to sterilize; this is called the filtered viral plug extract (FVPE). Applicant determined there was no difference in the percentage of agonadal F1 progeny when using either UVPE or FVPE for injections. (Table 3.) Applicant used FVPE for most experimentation.

TABLE 3

Comparison of unfiltered viral plug extract (UVPE) and filtered viral plug extract (FVPE) in their ability to cause agonadal F1 progeny with plug. Oviposition day is the day the infected female moth laid eggs. Eggs laid on oviposition days 3 and 4 were reared to adults.

| Oviposition day | Virus type | # Females evaluated for plug | F1 progeny females with plug |
|---|---|---|---|
| 3 | UVPE | 40 | 33% |
| 3 | FVPE | 25 | 36% |
| 4 | UVPE and FVPE | 35 | 74% |

Developing the Protocol to Generate a High Number of Agonadal Moths

Subsequent experimentation determined that injecting virus extracted from viral plugs results in a higher percentage of agonadal F1 progeny than injecting virus produced from infections of Sf9 cells in culture. Briefly, adult female moths were injected with 50-60 μl of either FVPE or virus amplified in cell culture. Eggs were collected on oviposition day 3 and reared to adults. F1 female progeny were evaluated for the presence of a plug. Almost all of the F1 female progeny developed a plug if F0 female moths were injected with viral plug extract, whereas only 10% of F1 progeny developed a plug if injected with virus collected from infected Sf9 cells. (Table 4).

TABLE 4

Comparison of virus isolated from infected Sf9 insect cells (cell culture) and isolated from viral plugs (plug virus) in their ability to cause agonadal F1 progeny as indicated by the presence of viral plugs.

| Virus type | Virus strain | # Females evaluated for a plug | F1 female progeny with plug |
|---|---|---|---|
| Cell culture | yfp HzNV-2 | 11 | 9% |
| Cell culture | KS-3 | 20 | 10% |
| Plug virus | yfp HzNV-2 | 26 | 100% |
| Plug virus | KS-3 | 20 | 95% |

Thus, the titer of virus amplified in cell culture used for infection of adult moths was not optimal. Titer is an important factor in developing a method for creating high volumes of sterile insects. The optimal viral titer will be as low as possible but sufficient to cause agonadal adults. To assess the effects of virus titer, adult female moths were injected with either $10^7$, $10^4$ or $10^1$ pfu/ml virus (WT or yfp HzNV-2) and mated with uninfected males. Eggs were collected on oviposition days 3-5 and reared to the adult stage. Moths were evaluated for the presence of a viral plug and egg production. Virus titer of $10^4$ pfu/ml led to a high number of agonadal F1 progeny on oviposition day 5 (Table 5) indicating that the virus replication in the host moth was important for effective transmission of the virus to the offspring eggs.

TABLE 5

Moths were either uninfected or infected with a low ($10^1$ pfu/ml), mid ($10^4$ pfu/ml), or high ($10^7$ pfu/ml) dose with either wild-type (WT) or recombinant yfp HzNV-2 virus. Eggs were collected on oviposition days 3-5, reared to adults, and the agonadal state of each female was evaluated by the presence of a plug.

| Virus group | Virus dose | F1 progeny collected on oviposition day | # females evaluated | # Eggs laid | F1 females with plugs |
|---|---|---|---|---|---|
| Uninfected | — | Day 3 | 7 | ~300 | 0% |
| | | Day 4 | 6 | 14 | 0% |
| | | Day 5 | 4 | 0 | 0% |
| WT-infected | $10^1$ | Day 3 | 9 | 5 | 0% |
| | pfu/ml | Day 4 | 5 | ~300 | 0% |
| | | Day 5 | 9 | 64 | 22% |
| | $10^4$ | Day 3 | 6 | 1 | 0% |
| | pfu/ml | Day 4 | 10 | ~150 | 20% |
| | | Day 5 | 10 | 0 | 100% |
| yfp HzNV-2-infected | $10^4$ | Day 3 | 4 | 0 | 0% |
| | pfu/ml | Day 4 | 4 | 0 | 0% |
| | | Day 5 | 10 | 0 | 70% |
| | $10^7$ | Day 3 | 9 | ~150 | 0 |
| | pfu/ml | Day 4 | 3 | 0 | 0 |
| | | Day 5 | 1 | 0 | 0 |

Injection of the recombinant virus into naïve male moths, followed by mating with healthy females, does not significantly reduce the number of eggs laid by female moths although the infection can be transmitted in this manner. However, when newly emerged female moths were injected with recombinant yfp HzNV-2 and mated with healthy males, the egg number was dramatically reduced (FIG. 4). This effect was dose dependent as a viral dose of $1\times10^6$ pfu exhibited fewer eggs compared to a viral dose of $1\times10^3$ pfu. The total number of eggs laid by female moths injected with WT HzNV-2 was not reduced relative to media injected controls; this effect is only observed with the mutant and recombinant viruses.

Methods of Sterilizing Adult Moths by Injecting the Insects with Virus at the Larvae Stage An alternative protocol for inducing sterility is to inject virus into 3rd instar larvae such that the injected insects exhibit the sterile pathology as adults. While this is not the normal mode of transmission, larval injections are much faster, amenable to automation and likely mimic the activation of viral replication (Rallis et al., 2002-a). Applicant has induced sterility in $3^{rd}$ instar larvae by syringe injection and direct inoculation with a needle dipped into a virus solution containing $10^6$ pfu/ml.

Infection Using Syringe Injection

Injecting supernatants from cultures of virus-infected cells into adult moths does not produce high numbers of agonadal offspring (Table 4). To determine if virus produced from infected, cultured insect cells effectively initiated productive virus infections when injected into larvae, Applicant injected virus-containing tissue culture medium into $3^{rd}$ instar larvae. $3^{rd}$ instar larvae (83 larvae per group) were injected using an insulin syringe with either WT HzNV-2, yfp HzNV-2, or KS-3 virus (25-50 μl) or not injected. Larvae were reared to adults. Surprisingly, none of the yfp HzNV-2-injected larvae pupated and eventually died (Table 6). However, ~95% of female larvae infected with either WT HzNV-2 or KS-3 virus produced a viral plug as adults (FIG. 5). Applicant concluded that while injecting virus amplified in tissue culture into adult moths does not produce many agonadal offspring, injecting virus amplified in tissue culture into $3^{rd}$ instar larvae was an effective method as almost all moths became agonadal.

TABLE 6

Larval and pupal stage mortality after injection of $3^{rd}$ instar larvae with WT HzNV-2, recombinant and mutant HzNV-2 derived from virus-infected insect cell cultures.

| Group | Insects survived injection and pupated |
|---|---|
| Uninfected | 100% |
| WT-infected | 60% |
| KS3-infected | 73% |
| yfp HzNV-2-infected | 0% |

Injection of viral plug extract into $3^{rd}$ instar larvae with an insulin syringe was also evaluated. Briefly, WT HzNV-2 and yfp HzNV-2 FVPE was diluted to $7\times10^3$ pfu/ml and $2.5\times10^2$ pfu/ml and 25 μl was injected into $3^{rd}$ instar larvae. Larvae were reared to adults and female moths were evaluated for the presence of a plug. Female moths that were injected as larvae with a titer of $10^3$ pfu/ml developed a viral plug, whereas only ~80% of those injected with $10^2$ pfu/ml developed a viral plug (Table 7). Applicant concluded that injecting $3^{rd}$ instar larvae with viral plug extract was also highly effective at developing agonadal adults, but titer should be around $10^3$ pfu/ml.

TABLE 7

Incidence of viral plugs after $3^{rd}$ instar larvae were infected with wild-type (WT) HzNV-2 or recombinant yfp HzNV-2\at viral doses between $10^2$ to $8\times10^3$ pfu/ml.

| Infection-group | Virus titer (pfu/ml) | Females with plug |
|---|---|---|
| Uninfected | 0 | 0% |
| WT-infected | $1\times10^2$ | 80% |
| WT-infected | $1\times10^3$ | 100% |
| yfp-HzNV2-infected | $4\times10^2$ | 79% |
| yfp- HzNV2-infected | $8\times10^3$ | 100% |

Infection Using Direct Inoculation Using a Pin

Direct injection of third instar larvae or moths are efficient methods for infecting HzNV-2 in the laboratory, but feeding is a preferred method.

Infecting *H. zea* with WT HzNV-2 via an oral route of infection is possible. Raina et al. (2006) fed WT HzNV-2 to $1^{st}$ instar larvae for 1-3 days and found that 9-17% (varies based on gender and duration of feeding) of adults became agonadal. Hamm et al. (1996) fed WT HzNV-2 to adult moths in an aqueous solution and from 60-100% of the offspring adults were agaondal. The HzNV-2 genome also encodes genes related to four baculovirus genes (p74, pif-1, pif-2, and pif-3) whose protein products are involved in viral entry per os (Burand, Kim, Afonso et al. 2012). Although the natural route of infection for HzNV-2 is through mating and/or transovarial transmission, other methods for infecting insects include direct inoculation and feeding of both larvae and adults.

A direct inoculation method for transmitting the virus to 3rd instar larvae (Table 8) was developed and may be amenable to automation. This method is similar to that used by Hamm et al., (1996) to infect $1^{st}$ instar larvae with viral plug extract with 9 of 10 larvae becoming agonadal as adults. Direct inoculation is a rapid means to introduce virus into *H. zea* larvae in which a sterile pin is dipped into the viral solution and then used to prick larvae between the head capsule and abdomen with sufficient force to penetrate the cuticle and enter the insect's body cavity. WT HzNV-2 (A, B) virus obtained from two different cell culture infections A and B) were used for direct inoculation. The pricked larvae were reared to adult moths, and female moths were evaluated for the presence of a plug. 57% (WT A) and 16% (WT B) of moths were agonadal.

To test virus isolated from plugs, ~$10^8$ pfu/ml of WT HzNV-2 or recombinant yfp HzNV-2 viruses were isolated, filter sterilized and used in direct inoculation experiments. The inoculated larvae were reared to adult moths and mated. All female moths developing from larvae inoculated with recombinant yfp HzNV-2 were sterile (no eggs laid; plugs in 100% of females). Upon dissection, all male moths examined were found to be agonadal.

For larvae inoculated with WT HzNV-2, 90% of female moths had a viral plug with the number of eggs laid commensurately reduced relative to controls (Table 8). In summary, the direct inoculation method not only was as efficient as injecting the virus into larvae, it also was much faster.

TABLE 8

Effects of direct inoculation of $3^{rd}$ instar larvae with wild-type (WT) and yfp recombinant HzNV-2 purified from viral plugs on moth sterility.

| Group | # of eggs laid* | % Female moths with plugs | State of reproductive organs in male moths** |
|---|---|---|---|
| Unpricked | High | 0 | 0% agonadal |
| Medium control | High | 0 | 0% agonadal |
| WT HzNV-2 | Low | 90 | 50% agonadal |
| yfp HzNV-2 | None | 100 | 100% agonadal |

*high: >700 eggs; low <200 eggs;

**determined by dissecting reproductive organs of *H. zea* males.

To investigate effects of titer on the direct inoculation method WT HzNV-2 isolated from a viral plug was diluted to $10^6$ pfu/ml and used to inoculate $3^{rd}$ instar larvae. Only 18% of WT HzNV-2 pricked females were agonadal with the $10^6$ pfu/ml inoculum. Many females, termed carriers, are infected with virus but have inactive or latent infections. Moths having latent infections have intact, functional reproductive tracts but can transmit the virus horizontally and vertically to their offspring. PCR using a primer set to the HzNV-2 ORF78 was performed, and all 20 of the females without viral plugs tested were carriers. Applicant concluded that use of direct inoculation with a lower titer of $10^6$ pfu/ml to infect $3^{rd}$ instar larvae created a carrier population.

Method of Infecting an Insect with the Disclosed Viruses

Alternative methods for introducing insect nudiviruses and baculoviruses are reported in the scientific and patent literature. The literature suggests that efficient infection is possible by feeding newly emerged (neonate) first instar larvae, by feeding adults virus in a sucrose solution, by adding fluorescent brighteners to larval diet, or by aerosol infections with virus in powdered or droplet form (Kirkpatrick et al., 1994; U.S. Pat. No. 7,261,886). A recent patent filing reports efficient baculovirus infection achieved by immersing larvae in a viral solution (US Patent Publication US2011/0314562).

In accordance with the instant disclosure, three different methods for infecting large numbers of larvae may be used as follows:

1. Virus Feeding. The protocol used by Raina and Lupiani (2006) may be used. Briefly, newly hatched *H. zea* larvae may be placed in a 100×15 mm Petri dish containing a diet with 1000 pfu of mutant HzNV-2. To increase the efficient uptake of the virus, the fluorescent brightener Blankophor may be added to the diet (Martinez et al., 2009). The larvae may be allowed to feed for 48 hrs then placed in diet-containing cups. *H. zea* is very cannibalistic and so must be housed individually at a young instar. The pupae will be sexed and emerged females will be analyzed for viral plugs, the ability to lay fertile eggs after mating, and the presence of intact reproductive organs.

The males may then be dissected and their reproductive organs examined to determine if they are agonadal. The presence of mutant HzNV-2 may be confirmed by PCR, as described above.

2. Virus Aerosols. The virus may be delivered as a lyophilized powder (Kirkpatrick et al., 1994) or as an aqueous mist (U.S. Pat. No. 7,261,886). 3rd instar *H. zea* larvae may be anesthetized with $CO_2$ and placed in a test chamber. The lyophilized mutant virus may be placed in the chamber at different doses and dispersed continuously throughout the chamber by a gentle stream of air, for a total exposure time of 30 min. Each insect may be sexed after they pupate, and after emergence, each moth may be analyzed for sterility as described above. For the aqueous mist deliver, a Potter precision laboratory spray tower (Burkard Scientific) may be used, and 3rd instar larvae may receive doses of mutant HzNV-2 from $10^2$ to $10^4$ pfu/ml. Agonadal pathology may be assessed in adult moths.
3. Immersion. *H. zea* larvae may be submerged in a HzNV-2 solution as described by Lu et al. (2011). This treatment method involves first stressing the insects at 4° C. for 15 hours before soaking the 3rd instar larvae in different concentrations of mutant HzNV-2 ($10^3$-$10^6$ pfu/ml) for 1 hr. Sterility in adult moths may be determined as described above.

Method of Protecting a Crop from Pest Insects

The instant disclosure addresses a method for control of lepidopteran pest moths by rendering them sterile from infection with mutant or transgenic sexually transmitted nudiviruses. The delivery of HzNV-2 or mutants formed thereof in accordance with the disclosed methods and compositions to the targeted population may be through established methods for release of moths for sterile insect control. In one aspect, the moths or other pest infected with a mutant virus as disclosed herein, are released at point locations and permitted to disperse over a range. The range may be, for example, about 800 meters from the release site or released aerially from planes, helicopters or drones. Moths infected with mutant or recombinant HzNV-2 may be released after infection using one or more of the disclosed methods at ratios from 0.1 infected moths/WT moth in the field population moth up to 10 infected moths/WT moth in the field population. Targeted release at lower ratios may rely on generational transmission of the infection for control and may require supplemental release on virus-infected adult moths. Similarly, the delivery of HvNV, HaNV or mutants formed thereof in accordance with the disclosed methods and compositions to the targeted population described herein, may be used through established methods for release of moths for sterile insect control. We have, therefore, identified and isolated the genomic sequences of HvNV (SEQ ID NO: 20); the predicted peptide sequence of HvNV ORF 90 (SEQ ID NO: 21); the predicted peptide sequence of HvNV ORF 92 (SEQ ID NO: 22) and the nucleotide sequence of HvNV pag1 (SEQ ID NO: 26). We have, also identified and isolated the genomic sequences of HaNV (SEQ ID NO: 23); the predicted peptide sequence of HaNV ORF 90 (SEQ ID NO: 24); the predicted peptide sequence of HaNV ORF 92 (SEQ ID NO: 25) and the nucleotide sequence of HaNV pag1 (SEQ ID NO: 27).

FIG. 7 is a schematic alignment of HvNV with HzNV-2 genome. This shows a high level of conservation of sequence (over 80%), predicted peptide sequence and gene order (synteny) within the viral genome. Such a high level of conservation is prima facia evidence of a required and conserved genetic function making it predictable in the state of the art to target the conserved genes to reproduce the effects mutation known to enhance sterility in the HzNV-2 genome. This it is predictable that mutations in HvNV and HaNV ORF 90, ORF 92 and pag1 will increase sterility in these viruses as they are known to do with the HzNV-2 genome.

Figure 1:
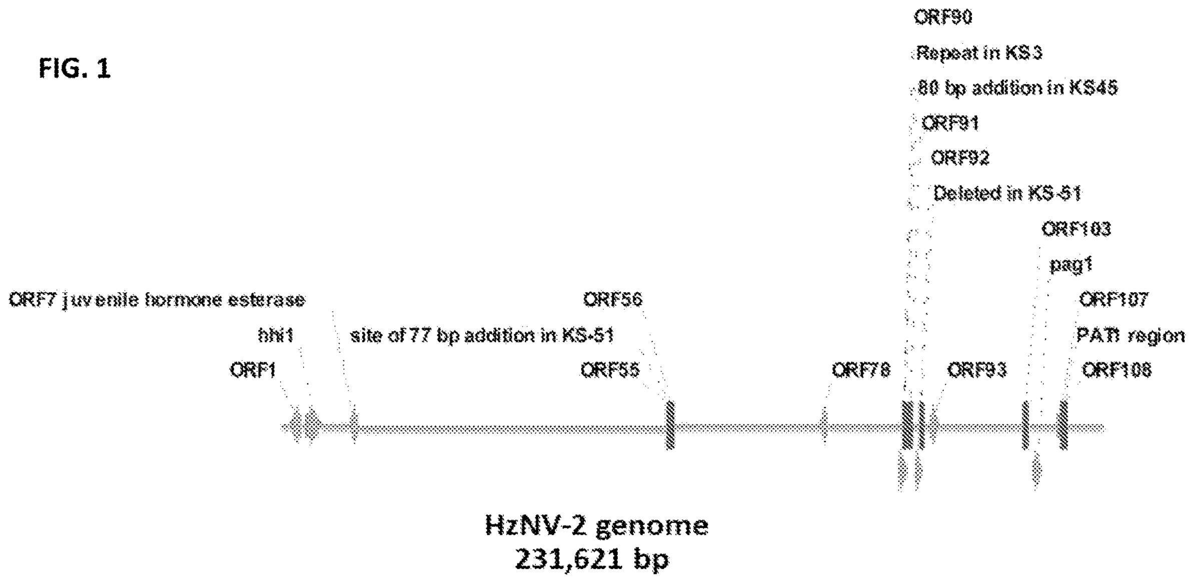
Figure 2:
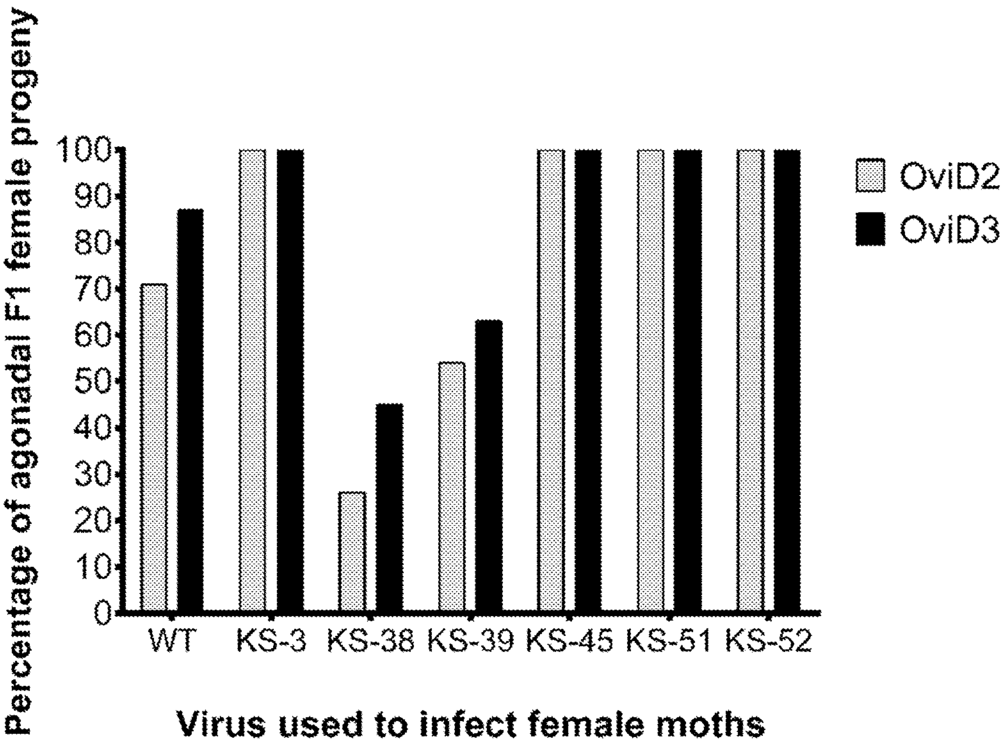
Figure 3:
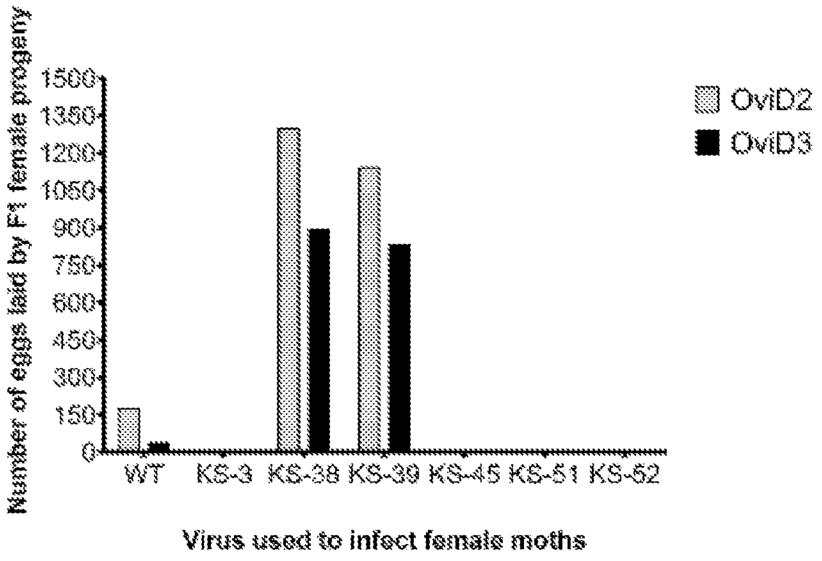
Figure 4:
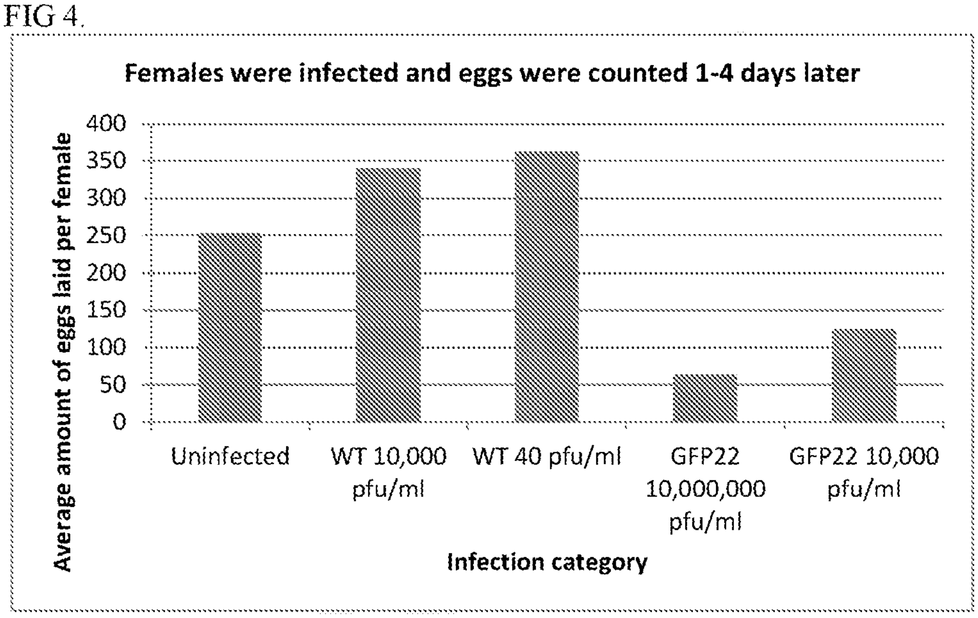
Figure 5:
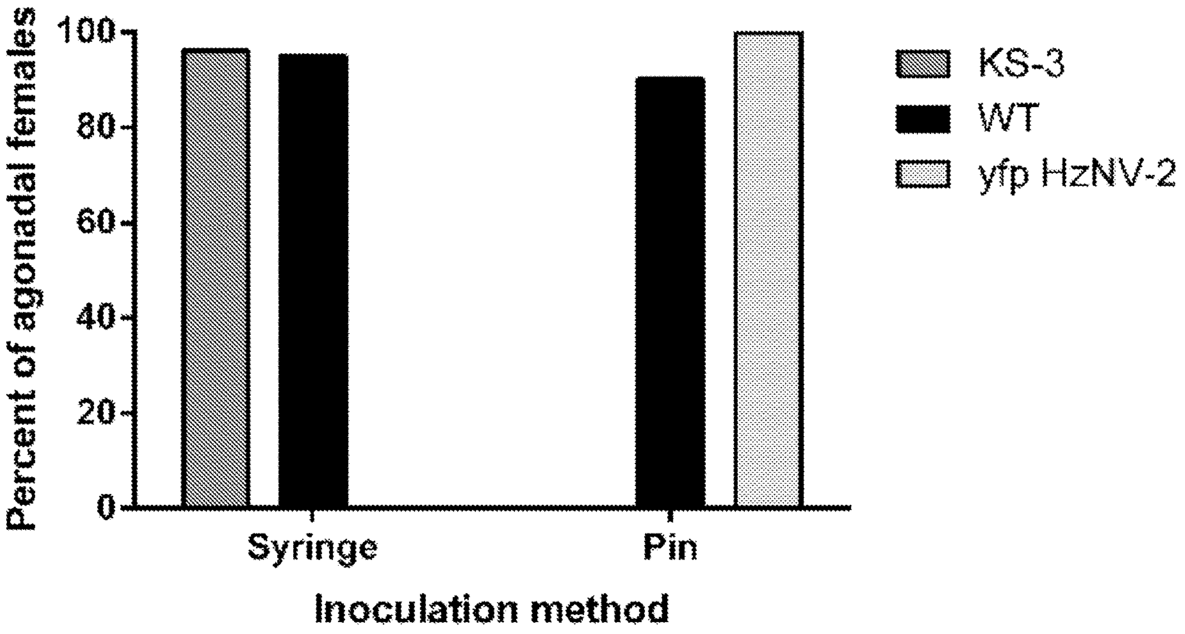
Figure 6:
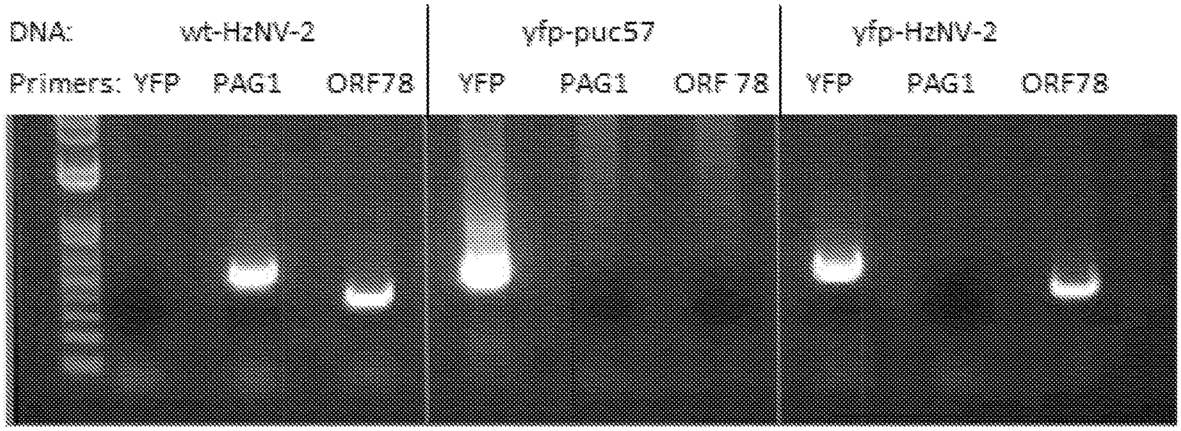
Figure 7:
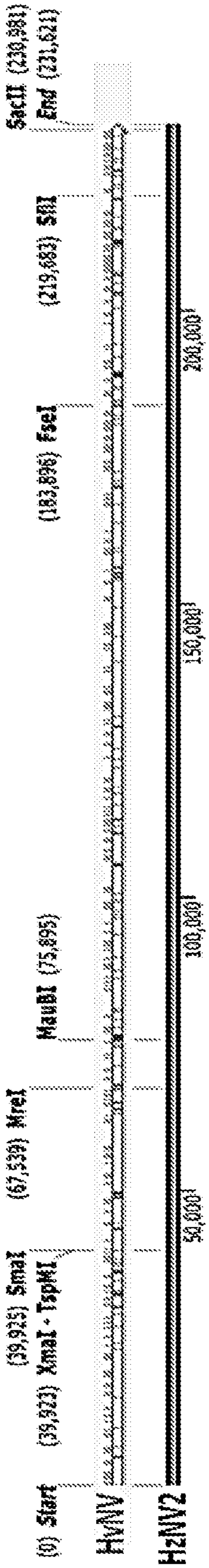
Figure 8:
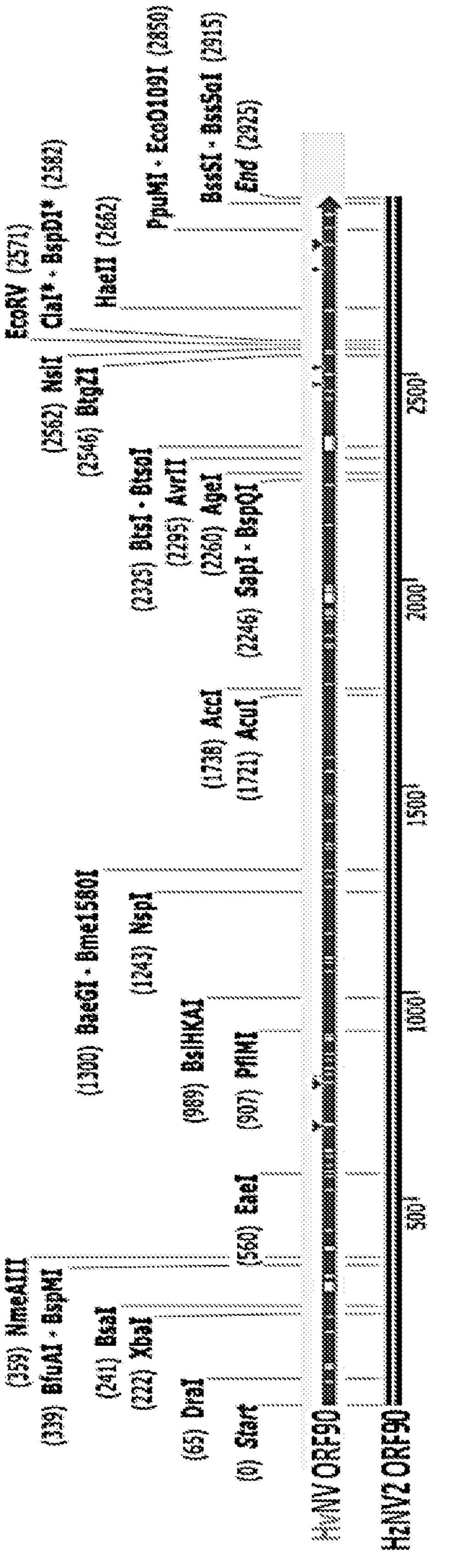
FIG. 8 is an alignment of HvNV ORF 90 with HzNV-2 ORF 90. This shows conservation of nucleotide and predicted amino acid sequences that is consistent with conserved functionality of ORF 90 between these viruses.
Figure 9:
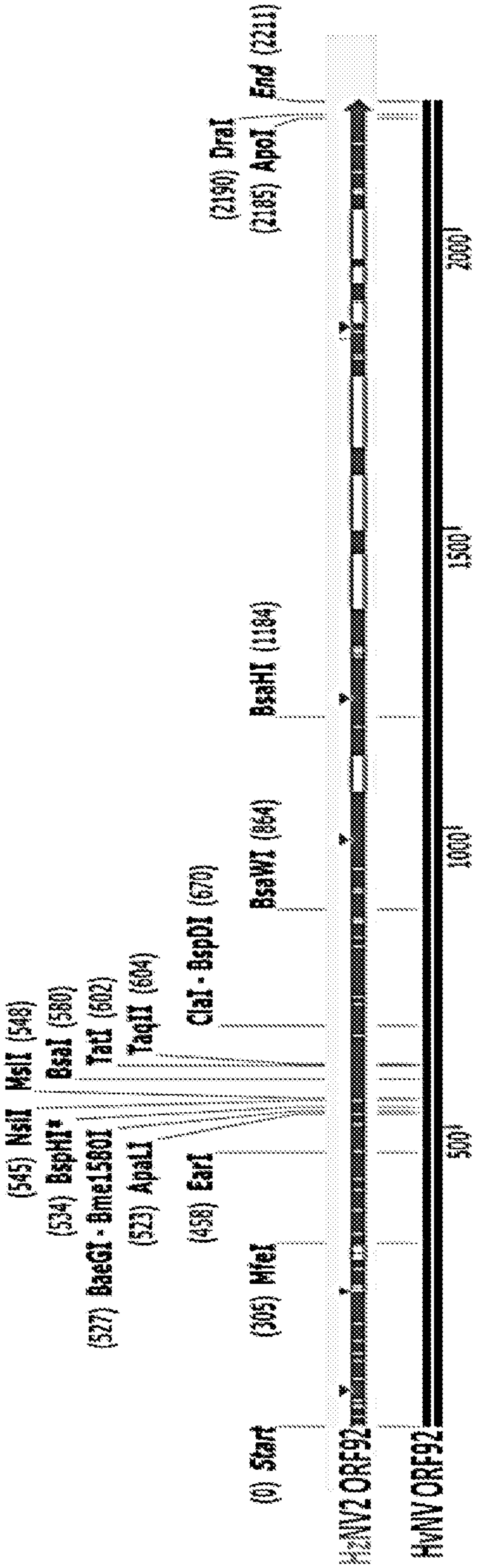
FIG. 9 is an alignment of HvNV ORF 92 with HzNV-2 ORF 92. This shows conservation of nucleotide and predicted amino acid sequences that is consistent with conserved functionality of ORF 92 between these viruses.
Figure 10:
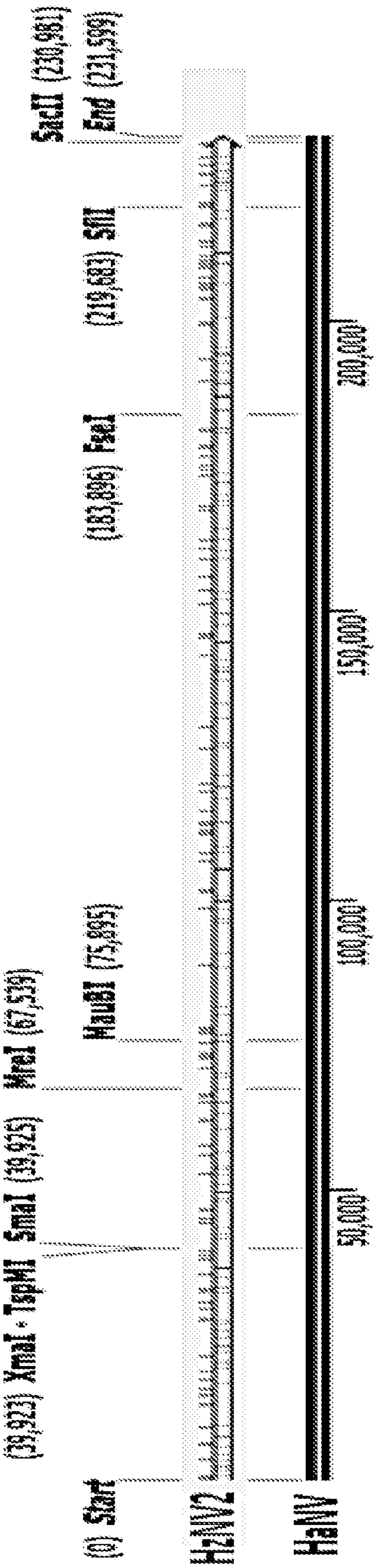

FIG. 10 is a schematic alignment of HaNV with HzNV-2 genome. This shows a high level of conservation of sequence (over 80%), predicted peptide sequence and gene order (synteny) within the viral genome. Such a high level of conservation is prima facia evidence of a required and conserved genetic function making it predictable in the state of the art to target the conserved genes to reproduce the effects mutation known to enhance sterility in the HaNV-2 genome. This it is predictable that mutations in HaNV and HaNV ORF 90, ORF 92 and pag1 will increase sterility in these viruses as they are known to do with the HzNV-2 genome.

Figure 11:
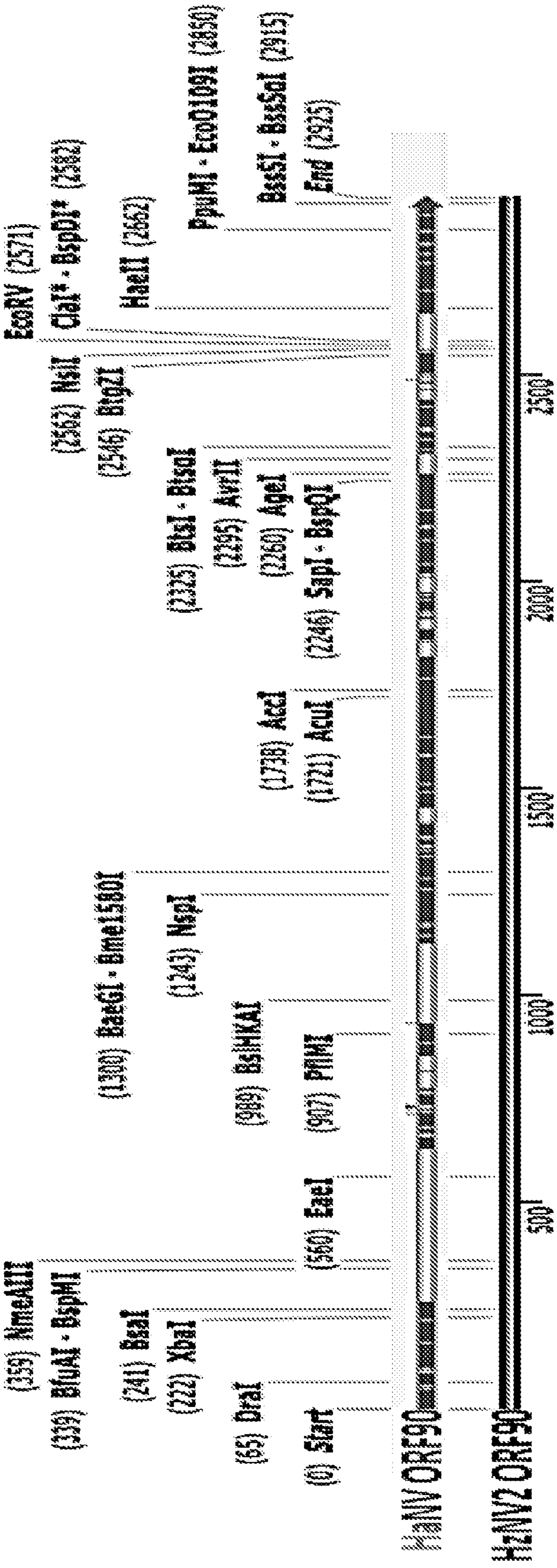

FIG. 11 is an alignment of HaNV ORF 90 with HzNV-2 ORF 90. This shows conservation of nucleotide and predicted amino acid sequences that is consistent with conserved functionality of ORF 90 between these viruses.

Figure 12:
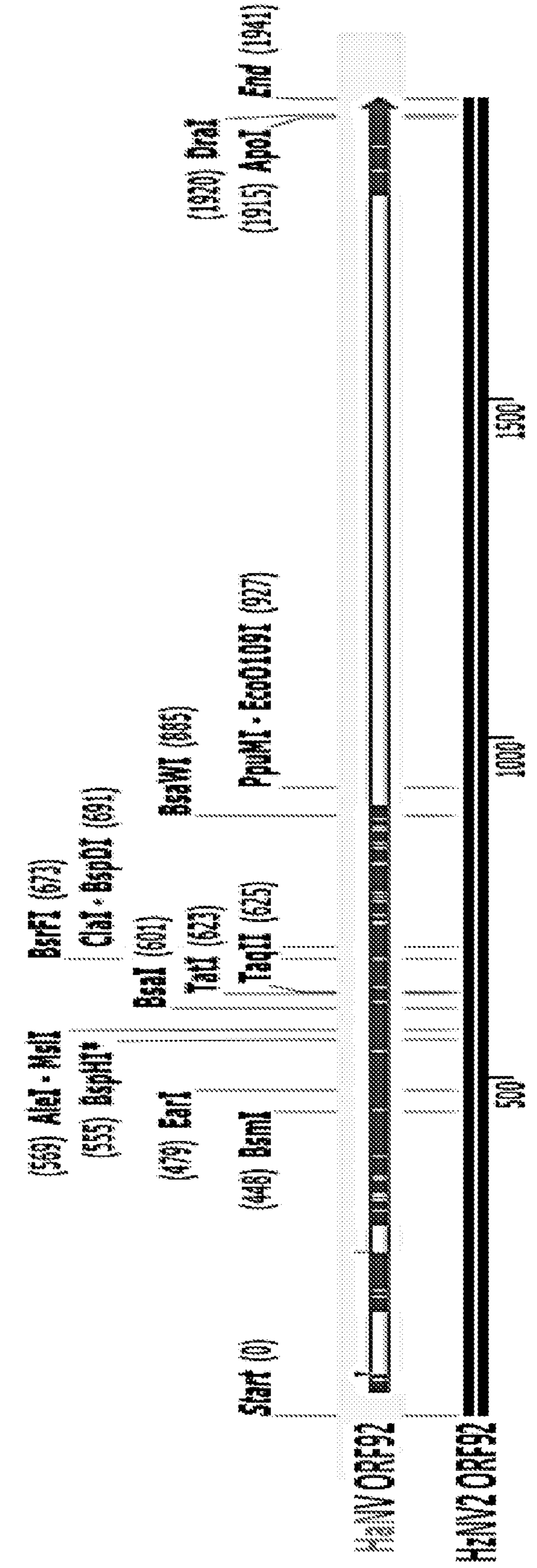
Figure 13A:
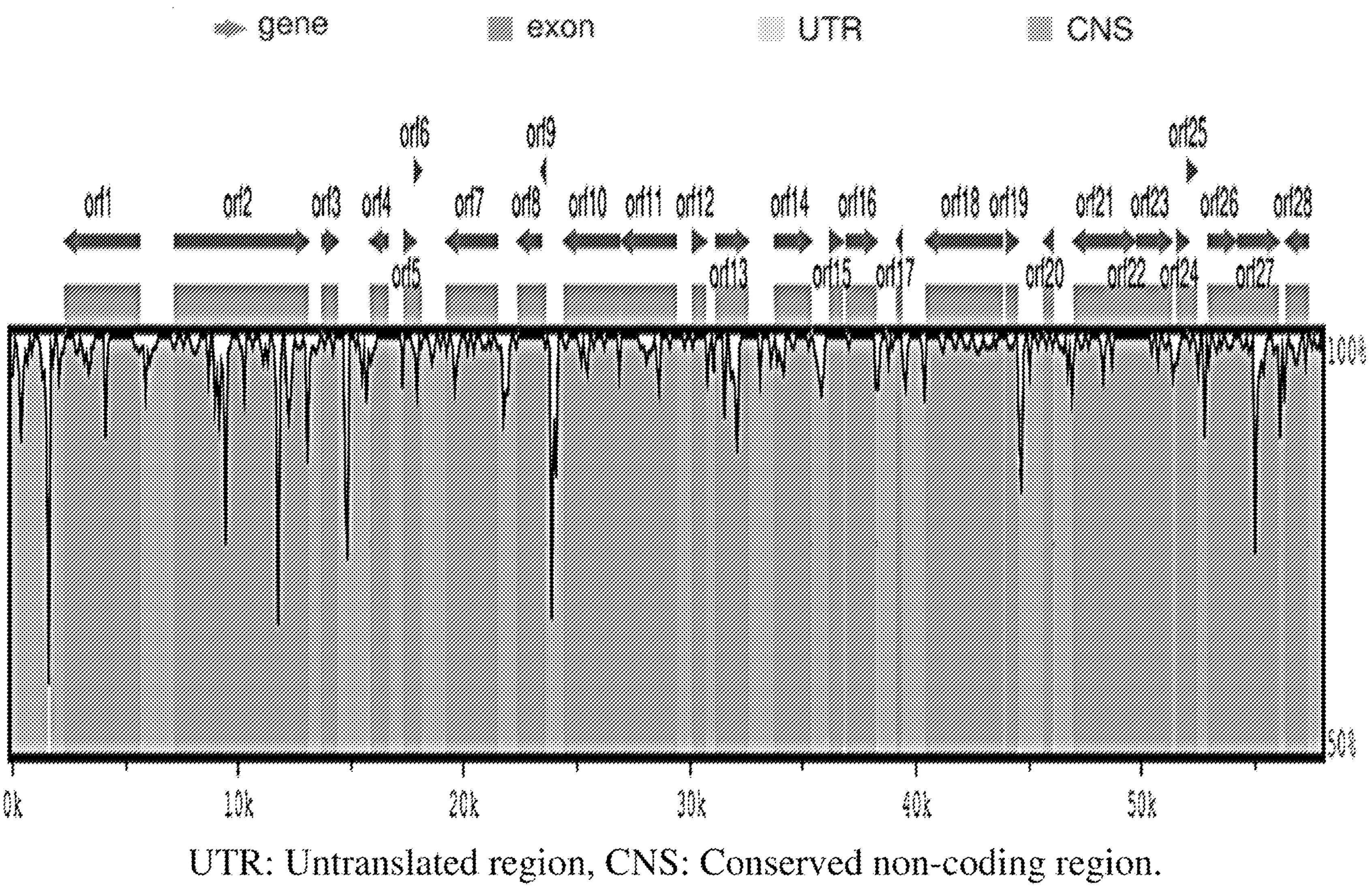
Figure 13B:
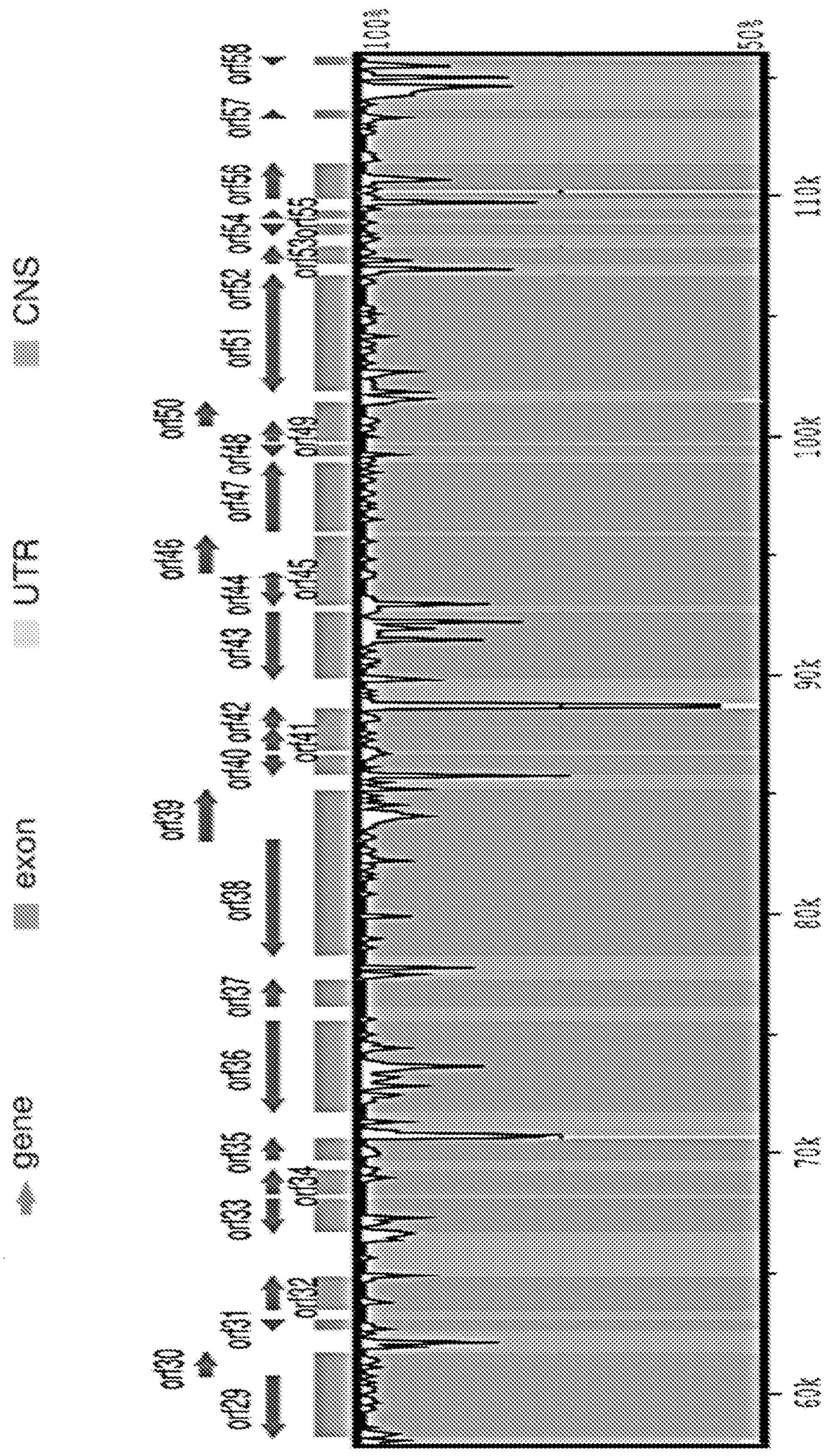
Figure 13C:
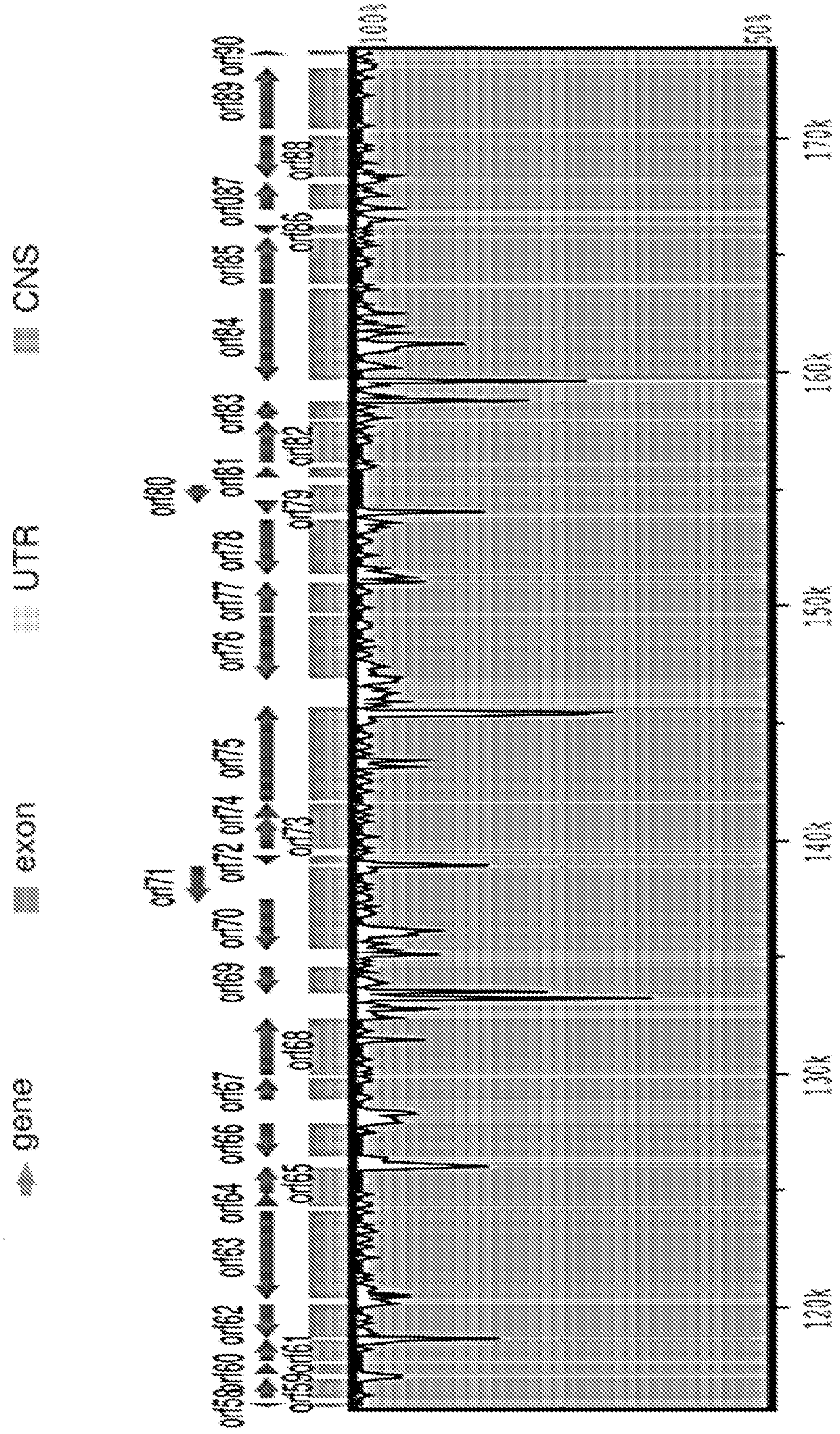
Figure 13D:
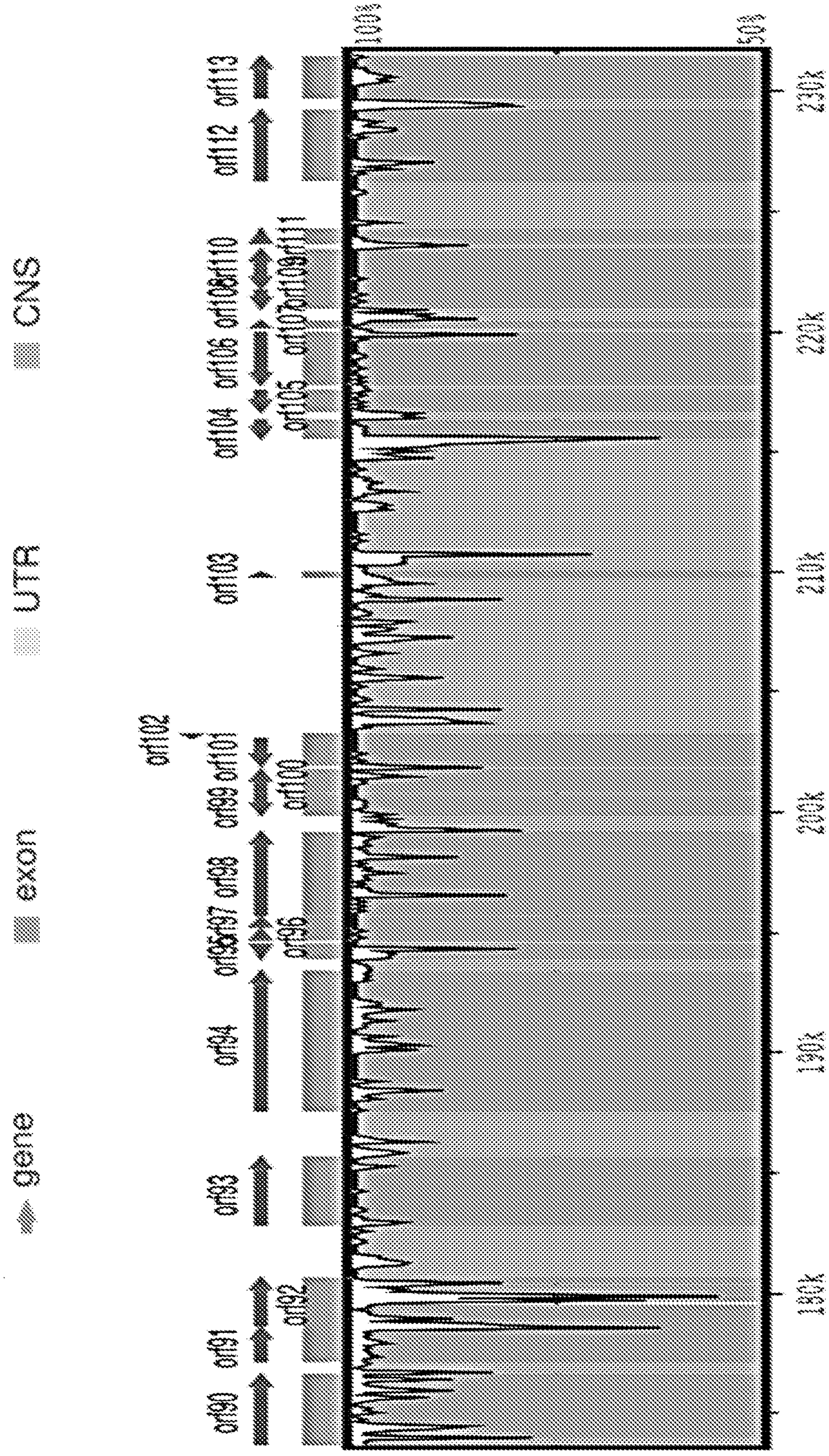

FIG. 12 is an alignment of HaNV ORF 92 with HzNV-2 ORF 92. This shows conservation of nucleotide and predicted amino acid sequences that is consistent with conserved functionality of ORF 92 between these viruses.

FIG. 13A-13D, together show the whole genome alignment of HvNV main contig and HzNV-2 genome. The bottom line represents the HzNV-2 genome and the top line represents the HvNV genome. Nucleotide variations are indicated as vertical lines and gaps. ORF distribution of HzNV-2 genome shown on top and the sequence similarity is represented at 100 bp resolution ranging from 50% to 100%. This shows sequence conservation and synteny across the entire genome consistent with viruses having closely related biological functions and pathology but preferential infect different species and are expected to be infectious to an overlapping host range when infected by sexual transmission, injection or feeding.

Figure 14:
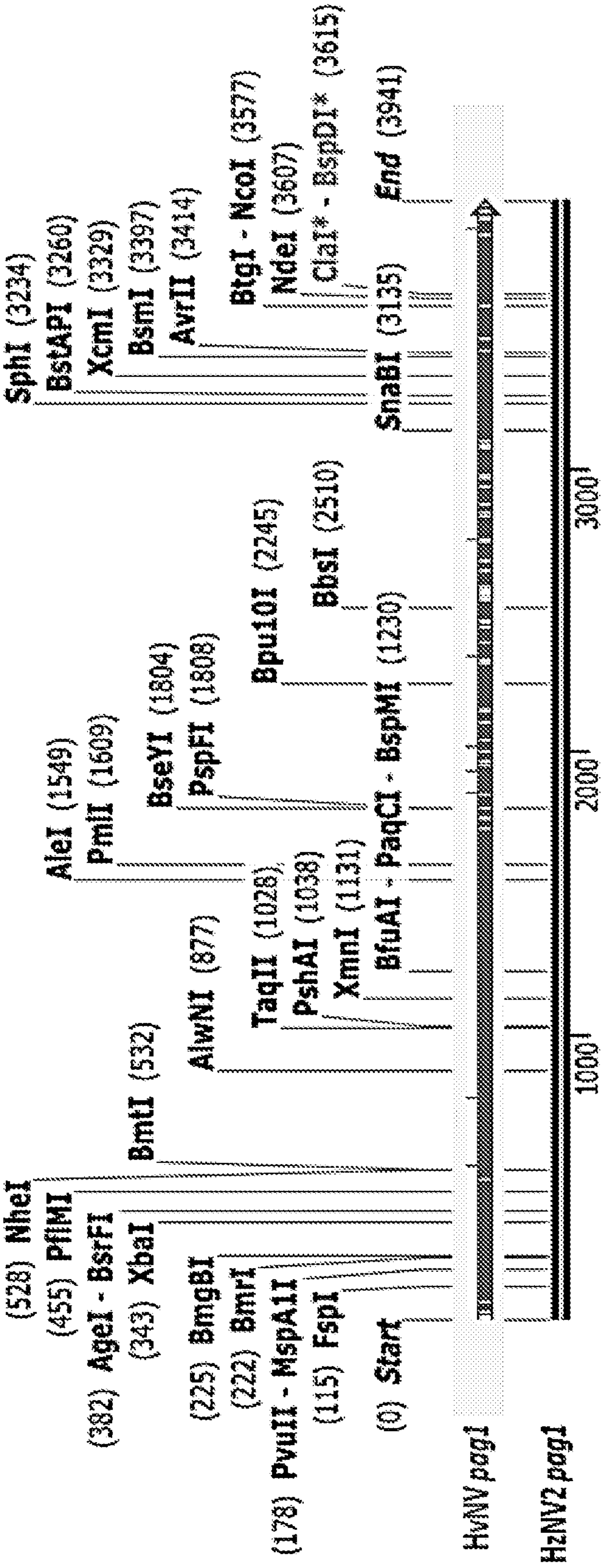

FIG. 14 is a schematic alignment of HvNV pag1 and HzNV-2 pag1 genome. This shows sequence conservation of this non-coding gene known to be involved in latency and known to increase sterility when mutated in HzNV-2.

Figure 15:
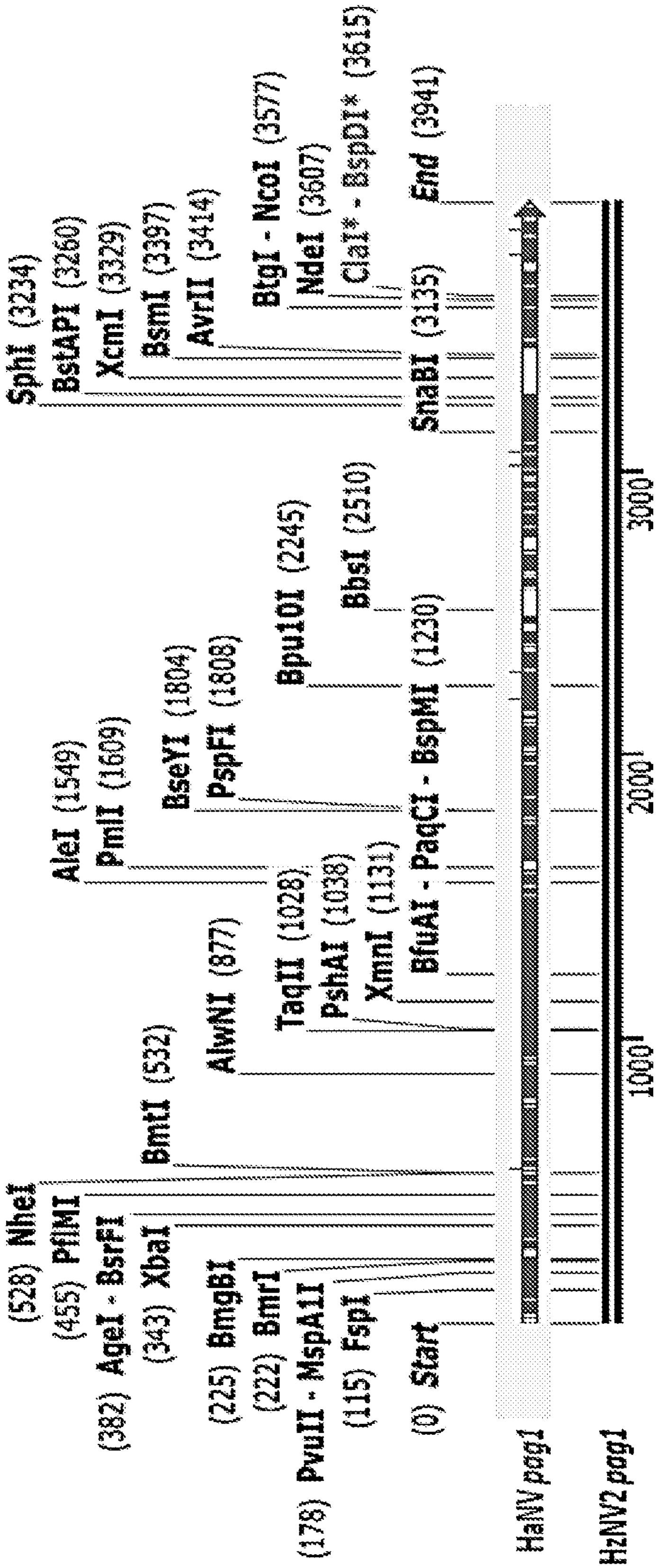

FIG. 15 is a schematic alignment of HaNV pag1 and HzNV-2 pag1 genome. This shows sequence conservation of this non-coding gene known to be involved in latency and known to increase sterility when mutated in HzNV-2.

Taken together, the evidence above supports genetic modification of the HvNV and HaNV nudiviruses is the identical manner as the HzNV-2 nudivirus and that the genetically modified HvNV and HaNV nudiviruses would be capable of being sexually transmitted by an insect useful for controlling pest populations. The genetically modified HvNV and HaNV nudiviruses would be capable of causing sterility in a target population of insects to control an insect pest population and reduce the crop damage caused by the target population of insects.

An implementation of the present invention may comprise a lepidopteran insect infected with a virus comprising a genetically modified *Heliothis virescens* nudivirus (HvNV) having at least one mutation in a region selected from the group comprising HvNV Open Reading Frame 90 (HvNV ORF90) (SEQ ID NO: 21), HvNV Open Reading Frame 92 (HvNV ORF92) (SEQ ID NO: 22) and HvNV Persistence-associated Gene (HvNV pag1) (SEQ ID NO: 26) to disrupt expression of the gene product encoded by said mutant region, wherein said virus causes increased lepidopteran insect sterility as compared to a wild-type HvNV virus.

The lepidopteran insect can be selected from the group consisting of *Helicoverpa zea* (*H. zea*) *H. armigera, H. assulta, Heliothis virescens, Agrotis Ipsilon, Spodoptera frugiperda*, and *Spodoptera exiguae.*

An implementation of the present invention may comprise a method of making a lepidopteran insect capable of transmitting a virus comprising a genetically modified *Heliothis virescens* nudivirus (HvNV) having at least one mutation in a region selected from the group comprising HvNV Open Reading Frame 90 (HvNV ORF90) (SEQ ID NO:21), HvNV Open Reading Frame 92 (HvNV ORF92) (SEQ ID NO: 22), and HvNV Persistence-associated Gene (HvNV pag1) (HvNV ORF92) (SEQ ID NO: 26), to disrupt expression of the gene product encoded by said mutant region, wherein said virus causes increased lepidopteran insect sterility in said lepidopteran insect, comprising infecting said lepidopteran insect with said virus.

The virus can be derived from a viral plug.

The virus can be administered orally to said lepidopteran insect.

The virus can be administered to said lepidopteran insect via direct inoculation of insect larvae or adult lepidopteran insect by puncturing the cuticle with a pin containing viral inoculum derived from a viral plug.

The virus can be administered to said insect via direct hypodermic injection into third instar larvae or moths.

An implementation of the present invention may comprise a method of protecting a crop from lepidopteran insect damage, comprising introducing lepidopteran insects infected with a virus comprising a genetically modified *Heliothis virescens* nudivirus (HvNV) having at least one mutation in a region selected from the group comprising HvNV Open Reading Frame 90 (HvNV ORF90) (SEQ ID NO: 21), HvNV Open Reading Frame 92 (HvNV ORF92) (SEQ ID NO: 22), and HvNV Persistence-associated Gene (HvNV pag1) (SEQ ID NO: 26), wherein said virus causes increased lepidopteran insect sterility in said lepidopteran insect introduced into said crop.

The crop may be selected from any one of corn, cotton, soybeans, tomatoes, sorghum, artichoke, asparagus, cabbage, cantaloupe, collard, cowpea, cucumber, eggplant, lettuce, lima bean, melon, okra, pea, pepper, potato, pumpkin, snap bean, spinach, squash, sweet potato, and watermelon, alfalfa, clover, cotton, flax, oat, millet, rice, sorghum, soybean, sugarcane, sunflower, tobacco, vetch, and wheat, avocado, grape, peaches, pear, plum, raspberry, strawberry, carnation, geranium, gladiolus, nasturtium, rose, snapdragon, zinnia, and combinations thereof.

The lepidopteran insect may be selected from *Helicoverpa zea* (*H. zea*) *H. armigera, H. assulta, Heliothis virescens, Agrotis Ipsilon, Spodoptera frugiperda, Spodoptera exiguae.*

An implementation of the present invention may comprise a method of reducing a lepidopteran insect population, comprising introducing into said lepidopteran insect population a lepidopteran insect infected with a virus comprising a genetically modified *Heliothis virescens* nudivirus (HvNV) having at least one mutation in a region selected from the group comprising HvNV Open Reading Frame 90 (HvNV ORF90) (SEQ ID NO: 21), HvNV Open Reading Frame 92 (HvNV ORF92) (SEQ ID NO: 22), and HvNV Persistence-associated Gene (HvNV pag1) (SEQ ID NO: 26), wherein said-genetically modified *Heliothis virescens* nudivirus (HvNV) causes increased lepidopteran insect sterility in said lepidopteran insect population.

The lepidopteran insect is selected from *Helicoverpa zea* (*H. zea*) *H. armigera, H. assulta, Heliothis virescens, Agrotis Ipsilon, Spodoptera frugiperda, Spodoptera exiguae*, and combinations thereof.

The lepidopteran insect population may comprise Bt resistant lepidopteran insects.

The genetically modified *Heliothis virescens* nudivirus (HvNV) may have a modification in one or more regions selected from the pag1 gene (SEQ ID NO: 26), the ORF 90 gene (SEQ ID NO: 21), or ORF 92 gene (SEQ ID NO: 22), wherein said modification disrupts or reduces expression from said region.

An implementation of the present invention may comprise a method of reducing a lepidopteran population comprising introducing into a lepidopteran insect population a virus comprising a genetically modified *Heliothis virescens* nudivirus (HvNV) having at least one mutation in a region selected from the group comprising HvNV Open Reading Frame 90 (HvNV ORF90) (SEQ ID NO: 21), HvNV Open Reading Frame 92 (HvNV ORF92) (SEQ ID NO: 22), and HvNV Persistence-associated Gene (HvNV pag1) (SEQ ID NO: 26), wherein said virus is introduced by feeding the virus to larvae or adults, wherein said virus causes increased sterility in said lepidopteran population as compared to a wild-type HvNV virus.

REFERENCES

Adamo, S. A., Kovalko, I., Easy, R. H., and Stoltz, D. (2014). A viral aphrodisiac in the cricket *Gryllus texensis*. J Exp Biol. 217(Pt 11): 1970-1976, PMID: 24625650.

Ali, M. I., and Luttrell, R. G. (2007). Susceptibility of bollworm and tobacco budworm (*lepidoptera*: Noctuidae) to Cry2Ab2 insecticidal protein. J Econ Entomol 100: 921-931, PMID: 17598557.

Ali, M. I., Luttrell, R. G., and Young, S. Y. 3rd (2006). Susceptibilities of *Helicoverpa zea* and *Heliothis virescens* (*lepidoptera*: Noctuidae) populations to Cry1Ac insecticidal protein. J Econ Entomol 99: 164-175, PMID: 16573337.

Arneodo, J. D., Balbi, E. I., Flores, F. M., and Sciocco-Cap, A. (2015). Molecular identification of *Helicoverpa armigera* (*lepidoptera*: Noctuidae: Heliothinae) in Argentina and development of a novel PCR-RFLP method for its rapid differentiation from *H. zea* and *H. gelotopoeon*. J Econ Entomol 108(6): 2505-2510, PMID: 26318007.

Bedford, G. O. (2013). Biology and management of palm dynastid beetles: recent advances. Annu Rev Entomol. 58: 353-372, PubMed PMID: 23317044.

Bergé, J. B., and Ricroch, A. E. (2010). Emergence of minor pests becoming major pests in GE cotton in China: what are the reasons? What are the alternatives practices to this change of status? GM Crops. 1(4): 214-219, PMID: 21844676.

Bézier, A., Thézé, J., Gavory, F., Gaillard, J., Poulain, J., Drezen, J. M, and Herniou, E. A. (2015). The genome of the nucleopolyhedrosis-causing virus from *Tipula oleracea* sheds new light on the Nudiviridae family. J Virol. 89(6): 3008-3025, PMID: 25540386.

Burand, J. P. (2013). Pathology and replication of the sexually transmitted insect virus HzNV-2. *Advances in Virus Research*. ISBN: 978-1477555-04-0. iConcept Press.

Burand, J. P., Kim, W., Afonso, C. L., Tulman, E. R., Kutish, G. F., Lu, Z., and Rock, D. L. (2012). Analysis of the genome of the sexually transmitted insect virus *Helicoverpa zea* nudivirus 2. Viruses 4: 28-61, PMID: 22355451.

Burand J. P., Tan, W., Kim, W., Nojima, S., and Roelofs, W. (2005). Infection with the insect virus Hz-2v alters mating behavior and pheromone production in female *Helicoverpa zea* moths. J Insect Sci. 5: 6. PMID: 16299596.

Burand, J. P., and Rallis, C. P. (2004). In vivo dose-response of insects to Hz-2V infection. Virology journal 1: 15, PMID: 15613241.

Burand, J. P., Rallis, C. P., and Tan, W. (2004). Horizontal transmission of Hz-2V by virus infected *Helicoverpa zea* moths. J Invertebr Pathol 85: 128-131, PMID: 15050843.

Burand, J. P., and Lu, H. (1997). Replication of a Gonad-Specific Insect Virus in TN-368 Cells in Culture. J Invertebr Pathol. 70(2): 88-95. PMID: 9281395.

Burand, J. P., and Wood, H. A. (1986). Intracellular protein synthesis during standard and defective Hz-1 virus replication. J. Gen. Virol. 67: 167-173.

Burand, J. P., Stiles, B., and Wood, H. A. (1983). Structural and Intracellular Proteins of the Nonoccluded Baculovirus HZ-1. J Virol. 46(1): 137-142. PMID: 16789238.

Burand, J. P., Wood, H. A., and Summer, M. D., (1983). Defective particles from a persistent baculovirus infection in *Trichoplusia ni* tissue culture cells. J. Gen. Virol. 64: 391-398.

CABI 2015 HyperTextTransferProtocol://WorldWideWeb.cabi.org/isc/datasheet/26776, wherein “HyperTextTransferProtocol” is “http”, and “WorldWideWeb” is “www”

Campagne, P., Kruger, M., Pasquet, R., Le Ru, B., and Van den Berg, J. (2013). Dominant inheritance of field-evolved resistance to Bt corn in Busseolafusca. PLoS One 8: e69675, PMID: 23844262.

Capinera 2000, revised 2007 UF/IFAS Extension HyperTextTransferProtocol://entomology.ifas.ufl.edu/creatures, wherein “HyperTextTransferProtocol” is “http”

Carriere, Y., Crowder, D. W., and Tabashnik, B. E. (2010). Evolutionary ecology of insect adaptation to Bt crops. Evol Appl 3: 561-573, EPA (1998). The Environmental Protection Agency’s White Paper on Bt Plant-pesticide Resistance Managment (EPA).

Chao, Y. C., Lee, S. T., Chang, M. C., Chen, H. H., Chen, S. S., Wu, T. Y., Liu, F. H., Hsu, E. L., and Hou, R. F. (1998). A 2.9-kilobase noncoding nuclear RNA functions in the establishment of persistent Hz-1 viral infection. J Virol. 72(3): 2233-2245. PMID: 9499081.

Chao, Y. C., Wood, H. A., Chang, C. Y., Lee, H. J., Shen, W. C., and Lee, H. T. (1992). Differential expression of Hz-1 baculovirus genes during productive and persistent viral infections. J Virol. 66(3): 1442-7448. PMID: 1738201.

Chen, H. H., Tsai, F. Y., Chen, C. T. (2001). Negative regulatory regions of the PAT1 promoter of Hz-1 virus contain GATA elements which associate with cellular factors and regulate promoter activity. J Gen Virol. 82(Pt 2): 313-320. PMID: 11161268.

Cheng, C. H., Liu, S. M., Chow, T. Y., Hsiao, Y. Y., Wang, D. P., Huang, J. J., Chen, H. H. (2002). Analysis of the complete genome sequence of the Hz-1 virus suggests that it is related to members of the Baculoviridae. J Virol. 76(18): 9024-9034. PMID: 12186886.

Cheng, R. L., Xi, Y., Lou, Y. H., Wang, Z., Xu, J. Y., Xu, H. J., and Zhang, C. X. (2014). Brown planthopper nudivirus DNA integrated in its host genome. J Virol. 88(10): 5310-5318. PMID: 24574410.

Cunningham, J. P., and Zalucki, M. P. (2014). Understanding *heliothine* (*lepidoptera*: Heliothinae) pests: what is a host plant? J Econ Entomol. 107(3): 881-896, PMID: 25026644.

de Miranda, J. R., and Fries, I. (2008). Venereal and vertical transmission of deformed wing virus in honeybees (*Apis mellifera* L.). J Invertebr Pathol. 98(2): 184-189, PubMed PMID: 18358488.

Ferrelli, M. L., Taibo, C., Fichetti, P., Sciocco-Cap, A., Arneodo, J. D. (2015). Characterization of a new *Helicoverpa armigera* nucleopolyhedrovirus variant causing epizootic on a previously unreported host, *Helicoverpa gelotopoeon* (*lepidoptera*: Noctuidae). J Invertebr Pathol. pii: S0022-2011(15)30008-2, PMID: 26296927.

Fitt, G. P. (1989). The ecology of *Heliothis* species in relation to agrosystems. Ann Rev Entomol 34, 17-52

Franz, G., and Robinson, A. S. (2011). Molecular technologies to improve the effectiveness of the sterile insect technique. Genetica 139(1): 1-5, PMID: 21258957.

Gherezghiher, T. B., Ming, X., Villalta, P. W., Campbell, C., and Tretyakova, N. Y. (2013). 1,2,3,4-Diepoxybutane-induced DNA-protein cross-linking in human fibrosarcoma (HT1080) cells. J Proteome Res. 12(5): 2151-2164, PMID: 23506368.

Granados, R. R., Nguyen, T., and Cato, B. (1978). An insect cell line persistently infected with a baculovirus-like particle. Intervirol, 10(5), 309-17.

Hamm, J. J. (1997). Gonad-specific virus of *Helicoverpa zea* does not affect infectivity of nuclear polyhedrosis virus. J. Entomol. Sci. 32(1): 106-109

Hamm, J. J., Carpenter, J. E., and Styer, E. L. (1996). Oviposition day effect on incidence of agonadal progeny of *Helicoverpa zea* (*lepidoptera*: Nocutidae) infected with a virus. Ann. Entomol. Soc. Am. 89(2): 266-275

*Helicoverpa armigera* TWG Report, Rev. 1, USDA APHIS PPQ Technical Working Group HyperTextTransferProtocol://WorldWideWeb.statista.com/topics/2062/genetically-modified-crops/, wherein "HyperTextTransferProtocol" is "http", and "WorldWideWeb" is "www".

Huang, F., Andow, D. A., and Buschman, L. (2011). Success of the high dose/refuge resistance management strategy after 15 years of Bt crop use in North America. Entomol Exp Appl 140, 1-16.

James, C. (2012). Global status of commercialized biotech/GM crops: 2012. In ISAA Briefs (Ithaca, NY: ISAAA).

Kempf, C., Michel, M. R., Omar, A., Jentsch, P., and Morell, A. (1990). Semliki Forest virus induced cell-cell fusion at neutral extracellular pH. Biosci Rep. 10(4): 363-374, PMID: 2249002.

Knell, R. J., and Webberley, K. M. (2004). Sexually transmitted diseases of insects: distribution, evolution, ecology and host behaviour. Biol Rev Camb Philos Soc. 79(3): 557-581, PMID: 15366763.

Lee, S., Park, K. H., Nam, S. H., Kwak, K. W., and Choi, J. Y. (2015). First report of *Oryctes rhinoceros* nudivirus (Coleoptera: Scarabaeidae) causing severe disease in *Allomyrina dichotoma* in Korea. J Insect Sci. 12: 15, PubMed PMID: 25765317.

Lee, J. C., Chen, H. H., Wei, H. L., and Chao, Y. C. (1993). Superinfection-induced apoptosis and its correlation with the reduction of viral progeny in cells persistently infected with Hz-1 baculovirus. J Virol. 67(12): 6989-94, PMID: 8230422.

Lin, C. L., Lee, J. C., Chen, S. S., Wood, H. A., Li, M. L., Li, C. F., and Chao, Y. C. (1999). Persistent Hz-1 virus infection in insect cells: evidence for insertion of viral DNA into host chromosomes and viral infection in a latent status. J Virol. 73(1): 128-39, PMID: 9847315.

Lupiani, B., Raina, A. K., and Huber, C. (1999). Development and use of a PCR assay for detection of the reproductive virus in wild populations of *Helicoverpa zea* (*lepidoptera*: noctuidae). J Invertebr Pathol 73, 107-112.

Luttrell, R. G., and Jackson, R. E. (2012). *Helicoverpa zea* and Bt cotton in the United States. GM Crops & Food: Biotechnol in Agriculture Food Chain, 3(3): 213-227.

Morrison, N. I., Simmons, G. S., Fu, G., O'Connell, S., Walker, A. S., Dafa'alla, T., Walters, M., Claus, J., Tang, G., Jin, L., Marubbi, T., Epton, M. J., Harris, C. L., Staten, R. T., Miller, E., Miller, T. A., and Alphey, L. (2012). Engineered repressible lethality for controlling the pink-bollworm, a lepidopteran pest of cotton. PLoS One 7(12): e50922, PMID: 23226548.

Nguyen, Q., Chan, L. C., Nielsen, L. K., and Reid, S. (2013). Genome scale analysis of differential mRNA expression of *Helicoverpa zea* insect cells infected with a *H. armigera* baculovirus. Virology 444(1-2): 158-170, PMID: 23827436.

Nguyen, Q., Palfreyman, R. W., Chan, L. C., Reid, S., and Nielsen, L. K. (2012). Transcriptome sequencing of and microarray development for a *Helicoverpa zea* cell line to investigate in vitro insect cell-baculovirus interactions. PLoS One. 7(5): e36324, PMID: 22629315.

U.S. Pat. No. 7,476,499: "Methods of identifying anti-viral agents" (use of DEB as mutagen)

U.S. Pat. No. 7,261,886 B2 "Insect larva aerosol infection method for producing recombinant proteins and baculovirus bio-insecticides"

patent #US 2011/0314562 A1 "Insect infection method for production of proteins"

Pichon, A., Bézier, A., Urbach, S., Aury, J. M., Jouan, V., Ravallec, M., Guy, J., Cousserans, F., Thézé, J., Gauthier, J., Demettre, E., Schmieder, S., Wurmser, F., Sibut, V., Poirié, M., Colinet, D., da Silva, C., Couloux, A., Barbe, V., Drezen, J. M., and Volkoff, A. N. (2015). Recurrent DNA virus domestication leading to different parasite virulence strategies. Sci Adv. 1(10): e1501150, PMID: 26702449.

Pushparajan, C., Claus, J. D., Marshall, S. D., and Visnovsky, G. (2013). Characterization of growth and *Oryctes rhinoceros* nudivirus production in attached cultures of the DSIR-HA-1179 coleopteran insect cell line. Cytotechnology. 65(6): 1003-1016, PMID: 23979321.

Raina, A. K., Adams, J. R., Lupiani, B., Lynn, D. E., Kim, W., Burand, J. P., and Dougherty, E. M. (2000). Further characterization of the gonad-specific virus of corn earworm, *Helicoverpa zea*. J Invertebr Pathol 76: 6-12, PMID: 10963397.

Raina, A. K., and Lupiani, B. (2006). Acquisition, persistence, and species susceptibility of the Hz-2V virus. J Invertebr Pathol 93: 71-74.

Rallis, C. P., and Burand, J. P. (2002a). Pathology and ultrastructure of Hz-2V infection in the agonadal female corn earworm, *Helicoverpa zea*. J Invertebr Pathol 81: 33-44, PMID: 12417211.

Rallis, C. P., and Burand, J. P. (2002b). Pathology and ultrastructure of the insect virus, Hz-2V, infecting agonadal male corn earworms, *Helicoverpa zea*. J Invertebr Pathol 80: 81-89, PMID: 12383433.

Reardon, J. T., Liljestrand-Golden, C. A., Dusenbery, R. L., and Smith, P. D. (1987). Molecular Analysis of Diepoxybutane-Induced Mutations at the rosy Locus of *Drosophila melanogaster*. Genetics 115: 323-331, PMID: 17246369.

Simmons, G. S., McKemey, A. R., Morrison, N. I., O'Connell, S., Tabashnik, B. E., Claus, J., Fu, G., Tang, G., Sledge, M., Walker, A. S., Phillips, C. E., Miller, E. D., Rose, R. I., Staten, R. T., Donnelly, C. A., and Alphey, L. (2011). Field performance of a genetically engineered strain of pink bollworm. PLoS One. 6(9): e24110, PMID: 21931649.

Skalsky, R. L., and Cullen, B. R. (2010). Viruses, microRNAs, and host interactions. Annu Rev Microbiol. 64:123-41, PMID: 20477536.

Smith-Pardo, A. (2014). The old world bollworm *Helicoverpa armigera* (Hubner) (*lepidoptera*: Noctuidae: Heliothinae) its biology, economic importance and its recent introduction into the western hemisphere. Boletin del museo entomológico 6(1): 18-28.

Tabashnik, B. E., Mota-Sanchez, D., Whalon, M. E., Hollingworth, R. M., and Carrière, Y. (2014). Defining terms for proactive management of resistance to Bt crops and pesticides. J Econ Entomol 107(2): 496-507, PMID: 24772527.

Tabashnik, B. E., Brevault, T., and Carriere, Y. (2013). Insect resistance to Bt crops: lessons from the first billion acres. Nat Biotechnol 31: 510-521, PMID: 23752438.

Tabashnik, B. E., Van Rensburg, J. B. J., and Carriere, Y. (2009). Field-evolved insect resistance to Bt crops: evidence versus theory. J Econ Entomol 102: 2011-2025.

Tretyakova, N. Y., Michaelson-Richie, E. D., Gherezghiher, T. B., Kurtz, J., Ming, X., Wickramaratne, S., Campion, M., Kanugula, S., Pegg, A. E., and Campbell, C. (2013). DNA-reactive protein monoepoxides induce cell death and mutagenesis in mammalian cells. Biochemistry 52(18): 3171-3181, PMID: 23566219.

Tyagi, A., Singh, N. K., Gurtler, V., and Karunasagar, I. (2016). Bioinformatics analysis of codon usage patterns and influencing factors in *Penaeus monodon* nudivirus. Arch Virol. 161(2): 459-464, PMID: 26586333.

Unckless, R. L. (2011). A DNA virus of *Drosophila*. PLoS One. 6(10): e26564, PMID: 22053195.

Walters, M., Morrison, N. I., Claus, J., Tang, G., Phillips, C. E., Young, R., Zink, R. T., and Alphey, L. (2012). Field longevity of a fluorescent protein marker in an engineered strain of the pink bollworm, *Pectinophora gossypiella* (Saunders). PLoS One 7(6): e38547, PMID: 22693645.

Wang, Y., Bininda-Emonds, O. R., van Oers, M. M., Vlak, J. M., and Jehle, J. A. (2011). The genome of *Oryctes rhinoceros* nudivirus provides novel insight into the evolution of nucleararthropod-specific large circular double-stranded DNA viruses. Virus Genes 42(3): 444-456, PMID: 21380757.

Wang, Y., and Jehle, J. A. (2009). Nudiviruses and other large, double-stranded circular DNA viruses of invertebrates: new insights on an old topic. J Invertebr Pathol. 101(3): 187-193, PMID: 19460388.

Wang, Y., Kleespies, R. G., Ramle, M. B., and Jehle, J. A. (2008). Sequencing of the large dsDNA genome of *Oryc-* tes rhinoceros* nudivirus using multiple displacement amplification of nanogram amounts of virus DNA. J Virol Methods. 152(1-2): 106-108, PMID: 18598718.

Wang, Y., Kleespies, R. G., Huger, A. M., and Jehle, J. A. (2007). The genome of *Gryllus bimaculatus* nudivirus indicates an ancient diversification of baculovirus-related nonoccluded nudiviruses of insects. J Virol. 81(10): 5395-5406, PMID: 17360757.

Wang, Y., van Oers, M. M., Crawford, A. M., Vlak, J. M., and Jehle, J. A. (2007). Genomic analysis of *Oryctes rhinoceros* virus reveals genetic relatedness to *Heliothis zea* virus 1. Arch Virol. 152(3): 519-531, PMID: 17106621.

Wijen, J. P., Nivard, M. J., and Vogel, E. W. (2001). Genetic damage by bifunctional agents in repair-active pre-meiotic stages of *Drosophila* males. Mutat Res 478: 107-117, PMID: 11406175.

Wood, H. A., and Burand, J. P. (1986). Persistent and productive infections with the Hz-1 baculovirus. Current topics in microbiology and immunology 131: 119-133, PMID: 3816297.

Wu, Y. L., Wu, C. P., Lee, S. T., Tang, H., Chang, C. H., Chen, H. H., and Chao, Y. C. (2010). The early gene hhil reactivates *Heliothis zea* nudivirus 1 in latently infected cells. Journal of virology 84: 1057-1065, PMID: 19889784.

Wu, Y. L., Wu, C. P., Liu, C. Y., Hsu, P. W., Wu, E. C., and Chao, Y. C. (2011a). A non-coding RNA of insect HzNV-1 virus establishes latent viral infection through microRNA. Scientific reports 1: 60, PMID: 22355579.

Wu, Y. L., Wu, C. P., Liu, C. Y., Lee, S. T., Lee, H. P., and Chao, Y. C. (2011b). *Heliothis zea* nudivirus 1 gene hhil induces apoptosis which is blocked by the Hz-iap2 gene and a noncoding gene, pag1. Journal of virology 85: 6856-6866, PMID: 21543471.

Wu, Y. L., Liu, C. Y., Wu, C. P., Wang, C. H., Lee, S. T., and Chao, Y. C. (2008). Cooperation of ie1 and p35 genes in the activation of baculovirus AcMNPV and HzNV-1 promoters. Virus Res. 135(2): 247-254, PMID: 18486255.

WorldWideWeb.usda.gov/nass/PUBS/TODAYRPT/acrg0615.pdf (USDA "Acreage" 2015 ISSN: 1949-1522), wherein "WorldWideWeb" is "www"

Yang, Y. T., Lee, D. Y., Wang, Y., Hu, J. M., Li, W. H., Leu, J. H., Chang, G. D., Ke, H. M., Kang, S. T., Lin, S. S., Kou, G. H., and Lo, C. F. (2014). The genome and occlusion bodies of marine *Penaeus monodon* nudivirus (PmNV, also known as MBV and PemoNPV) suggest that it should be assigned to a new nudivirus genus that is distinct from the terrestrial nudiviruses. BMC Genomics 15: 628, PMID: 25063321.

Yazaki, K., Mizuno, A., Sano, T., Fujii, H., and Miura, K. (1986). A new method for extracting circular and supercoiled genome segments from cytoplasmic polyhedrosis virus. J Virol Methods 14(3-4): 275-283, PMID: 3539959.

Zhao, X.-C., Dong, J.-F., Tang, Q.-B., Yan, Y.-H., Gelbic, I., Van Loon, J. J. A., and Wang, C.-Z. (2005). Hybridization between *Helicoverpa armigera* and *Helicoverpa assulta* (*lepidoptera*: Noctuidae): development and morphological characterization of $F_1$ hybrids. Bulletin of Entomol Research 95: 409-416.

All percentages and ratios are calculated by weight unless otherwise indicated.

All percentages and ratios are calculated based on the total composition unless otherwise indicated.

It should be understood that every maximum numerical limitation given throughout this specification includes every lower numerical limitation, as if such lower numerical limitations were expressly written herein. Every minimum numerical limitation given throughout this specification will include every higher numerical limitation, as if such higher numerical limitations were expressly written herein. Every numerical range given throughout this specification will include every narrower numerical range that falls within such broader numerical range, as if such narrower numerical ranges were all expressly written herein.

The dimensions and values disclosed herein are not to be understood as being strictly limited to the exact numerical values recited. Instead, unless otherwise specified, each such dimension is intended to mean both the recited value and a functionally equivalent range surrounding that value. For example, a dimension disclosed as "20 mm" is intended to mean "about 20 mm."

Every document cited herein, including any cross referenced or related patent or application, is hereby incorporated herein by reference in its entirety unless expressly excluded or otherwise limited. The citation of any document is not an admission that it is prior art with respect to any invention disclosed or claimed herein or that it alone, or in any combination with any other reference or references, teaches, suggests or discloses any such invention. Further, to the extent that any meaning or definition of a term in this document conflicts with any meaning or definition of the same term in a document incorporated by reference, the meaning or definition assigned to that term in this document shall govern.

While particular embodiments of the present invention have been illustrated and described, it would be obvious to those skilled in the art that various other changes and modifications can be made without departing from the spirit and scope of the invention. It is therefore intended to cover in the appended claims all such changes and modifications that are within the scope of this invention.

SEQUENCE LISTING (27 sequences)

SEQ ID NO: 1 - DNA, 231621 bp, Helicoverpa zea nudivirus 2
  source 1..231621: mol_type = genomic DNA
gtgctctaaaatgtcaatttgcatctcaaagactgcaaacttgtatgccttaaaatggtgccattaccgtgtctagttttgtactttgggctttacttttgggctttactttagacgttaagatactcgatttagatactattcttgtcacaagtgaaaccaatgtcacaagtgaatgtcaaactaatatcacaagtgaatatcacaagtgaaactaatgtcacaagtgaatatcaaactaatatcacaagtgaaactaatgtcacaagtgaatgtcacaagtgtacagtacaaatgtattagtgttaggattgaaccaagtatggttatttagaagtaagatgtaagtagtgtgtagtaggtagtaagtggtaagtaacaagtagtagtatgtagtagtacgctagttgtttagtattctagttgtttagtattctagttggccagtatgctagttagattcaactattgatttagtttaaattataatgttactgttgaagaggtagtgtttaagagttctgttgaagagttattgtttaagaattactgttgaagtagagttactattgaaagttactattgaagtagatttaagaattgtgtgccacctatgaaaaagactatacttgcccatctattttatacatgtattttagagtatttttagagtatttttagagtatttttagagtattttagagtcaagtttatattagtattttaaagttaactatatttagatttaaatacctagtagagttatatacaaatgtcaaatatcaacaagatgaaatatcaacaagataataaaaagtgtttacaacaatcaatcagacttgtatcatttaaagtatccaatcattgtatccaatcattgtatccaatcattcaagcaacccattaccagattgcctcccagactaccattcacttggctaaagtgtcaattgccgtctttcattgaactcgcacatattgccataataatactacctacccactttaatccctctctcactctaaggtcaaacctcaggcaaattgctcaggtctcagatctcagtctcagttctcgggttttgtttagagttgtatagttggcagttgcctttgtttataatttacatcgttgtttataccaagtctcgccatacacacacttttcataggtactcttcacaagtacttctcagtactagttgggcactctccatagaggaagtgtgtgtatattgtttatatgatagtttatacgatagtttgtttatatgctagtttgtttatatgatggttgactggtggcgataccactggtggtgataccaaatgaatttattatataaacattgtgtgtcatcaaaacagtgtgactgccatctttaggtagtgtatcaatctctatgttgactgtgtacttgaactgtacttggttgtatgcattgaatcggtatagggctgtattgaatctgtaggtatagggttatattgaatctgcatagcgagactctttgctagcacgactcctagcactaatctctccatctctctacacccagtagtcttacatattactaccatctaatgataccatcatctaatagtactacaatccaatggtaacatacatcccatctaatggtgccaccatctaatggtagcctacatccctaactaggcaaatcatgatttgtttgacatcatgattttagagtgaaggcactctggcaaaaaatgtaaacaaacacagcaaggatcaaggtttataggaatcagtaaaataccaaggatacagtttacacatgcatttattgaggtttatttataggggtttattatacagtgtacatttatggtttgaaataaaatgtaaaacatgattaaaattacacttgtaaaataacgggtatatttagtataaatggaatggtatacaagagtgtgtctttaataataagtgtctttaataaaaggtttagtttatctaaatatagattctttattacatctaaatacaaggtttaaccataatgtctaaatataaagtctaaatataatggctctatataattcctctataatctacatatttcctctatacaaagaatacaaaagtacaaaaaaaagagtattaaaatagtaggtaggtaggtaggtaatataaaagagtacaaaaatacaaaaggttacaaaaatataaaaagagtacaaaatacaagagtacaaaaagaacaactaaatagaaccaaagttcctccaaacataaaacataaatcaaaaaaacaataatctactcatgtatacaacgagtcaaacatggcgtggtaaaggttgaccgtgtcggtcatctttacaccaatcatgctcttgaaatctttggccattaaagttttacgacccgagtttaacattacaatataggccgcctccaataaccgagccagatagcactcggtcacgtctcgcatcaacaacagagcctggcccctgtatcggagatgcacaacttggtaagagtcgatctgaatttcgatattcttccaggcacgacaaaaaggcaaagtcggtatgaattgcattttacacgatttggacttgatcaatttaatcatgtatgccacatcaaacttttcatcttttgcactgccaggatccctaccctcgtaatcgtaatcgtctgccaatacacgcaaacctacagactttagaatagatttaatgtcacgaatctctacagtcttgcgcttaccgcactctaccaacagagtcacacgacgcttgacctccttcatgaaaaactctatgattctactcagctctggatagacatcctttgagattctatctatacccaatcgttcagcaaaacgtctaataatgttcttgtttataaagttgatactttgagactttttaagacgctctgcacgcatggcggcaattctactaccgccaccggcttcactagagattttatgaatacgcggcaccttggtggcaatgggtagagttctaactgtgggcacattggcgggagcctttacaaaaaggtatttgcgctgttgttccctcttgtcaattttggacttggcggcctcatcggtggatggggatttgtatggagaggcaggggttttgggagctggggattcgggtacagagtttgagttgttggtattgggtgtagatggttcagtgtttgttgtaggtgtagatggttcagtgttggattcagaggttgatggtgcaggactatttgttataggtgtagatggttcaatgtttgttataggtgtggatggttcaatgtttgttgtaggtgtaggtgtaggtgcagatgactcagtgttgggttcaacggttgatggagcagggcttgatgtaaatgtagagggagttgctttaggcttggaactgggtttgggtttgggtgcagagtttgctttagctttagacttggctgcatcagttttaggtttaggtttgggatcagatttagacttggaaacgttttcggttgtttcagtgtccgagtcttgatcgtcagaaatgaactctttggacttgtattgcttggaacgtttggatttagaattggatatggtcttgtacggcaatggaagggttggtatagggataccgttagagtctactctaggagtggtgggttgtttaaaaataatggtaacattttgatttggagtgttggttggaggtttggatttcgggttgggtttcggtttgggtttgggttttgcagcagattgtttaggagcaataggtttaggaatagtagtagtttgtttaggaacactagttggttgtttaggatcaggtttaggagacttgggtgcaggcttggtgttttcaacagaagaagcaacaacagtagagttggactttgtcgttttgggattggatgcctcctttgcattggatgactcttcatcctcagagtccgagctaccactactatcattgtcgctactaccactatcctcgctaccactactctcttcatcgctgctgtccgaatccgactctggtgccggtgatttggattgagtggtgttaatctgtttacgagcaatcagtggtttaggggcaatctcagagtttgattcggacgcattgggtgggttagagtttacactagcacctacatttcctacagaatccttctcaacctctttgtgcaaattttccattgagcgttctacatcagagccaatgtttgacaagttgattggtacattggacatggatgtattagatgatgcattcgatgctgcatattcttttgttgcagcatttacattgttgttggactctactacactagttgcatttacattgacagttgttatagattccaccgaaccgtttacatcgtcaatctccatagcagcgttggacgcgatcgattctacacccgagtcaaattgcgcattagactctacgctattggccgcagtgtcgtaagtctgatagcccttgtttgcagtgtgatcaaacttgacatactttttgtgtctgtattcagatggtttattttgaataatgggtttgatcacagtcgcatcctgagctgcagacttggcctgatctactaccggtttaactgtaacaatgttgttgtgtgcgtttaatggacgagtgttaaaagatgaaacactaccgctactagcagtggtagcagttgcgctagcgctactagtattggcaatggtgaatgtattacctgccgactctgctgcggtagtagagcgcgtaaccatagtcttgatgccggccgaaccactacgtaacactttaccgccgccgatattctccttttcatgtgtacgtttacgactctgcattttggacacgtcaacgatctcgtattgagtgtttaataaaccaatttctagttctgtgttgccttgacctgaatttataacctctttgcgcgggaactcgacacgtactgaatttagcgcctctcccttctcctgcgcacgcgggcgtttacctactacagtagtcatgacactattgtcgtctaatatggaagtgtacgtagtcttgttgttattgttattattattataattgctgtaatctacacattggtcctcgtcatcggtttcgataccgctacgtttaggagtgccgtccgcgtttatacgtttgccgatagatggagccgccctaggggtatctttaaagtttaaaaaggtcctcataaatttaagcttgtcctcttcgagttccattgcatgttgcatgtcgggagtcggagtgtttagcgtgtctctataaacaaaagatgatggattgtttgacatctctgcttgattgttattggcaacatcaaacacgggaatttcaaagcccaagtcatgcatcgtaatgttgggagcagcagtattgccgagttcatgagccatgttagtattggtggttggaatgggaaagattgtagtaccaggaaagatggttgcggtgtcgggcatcattggattgaaattgtacccatagccgttgggataagtgtttggatacatcaagttgttgtatacaaactcgggttgttgatagtactggggattagttttagaacggggacttttaccggtaggattcatgcttacaagcttctacttatacttctacttctactaacaccagttgttacaattacagtacactaagagtaaataaataataagagtaaatttacaattgcagtacactaagagtaaatgaaaagagtacacaaggataaatgaataaagagtaaagtaaagtagtaaagtaatacaataataaaatagagttaaataacaagagtaaatgggatgcaactaaaactacaattcaaactataatgcaagtcctaaaatacaataacatgcaaagtaaaactaaaatgcaaagtaaaactaggatgcaaagtaaatataaaatgcaaaccaactctaactctatactacaaaaacactagtctagtatacagcagccgcagtggagtcccttgtagcagcagtagatgcactagatgcagagtgcaaaaacaccagtatacgccactagcaaactacaccagcaaacactataccagcatacaccacaccaacacagcaggcagagtttagagatgtgtaattttaaagtcacctggttactttactggtaaaagtgcacaccagagcaagagtcgctcagagcaaccggtagagtagcaccacagtgcagtgtagaacagggcaggagcaagtctcgagctcgagcacaagacaatgtgcgagctcagagagagatatgtgttcaaagagagaacaccaccacacaacgccacaacgccacaaaacacacacacaagtctttggtagagtctttggtatttttttagagtacaagtctttggtaaatatatatttgatataaatgacaagtctttggtaaatatatttggtatcgggtattcagagcctaaaagacttctgaacaattacaaatccagcaaccggaatgcaattaaaacacttgtgttttgtaagcaaaactcaaatccaaaatttaattctggaattgtaggtttacgtacacactggaatataatttgcattaattcgggcaaaatctagccgtctagccgggatctaggagctgaatataggtcaggataggttttttgcttttatatggcctagattccaactttggaggggtgaattaatagggatttaatagtcgagtcgttttgtatatacatatatagaaaattgtatttaacaggccattaattgaactttaacagcaatttaacattaatttaacagcaattttaatatgttccagatacctaccgtacgcccactgaaaattcttcatataaatacgataatggtaggtgttggctacataatagctttagccaccctgctgtacgtacattttcctgtttattcagtcagtgtacggactctgtgcggataaatactgttattctccgagttttggagtttttattctgaaattccaactcggtaaaaatcacaagtctgtgctacaactctagtacaagtgctaaactctgatactagtgattggctccaacactagtgaccaaactttaccaagtgattgactctgatactagtgatttacacaagtgttcaactctcctctacaatcatgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggatgaggatgaggatgaacctatgcgtgaaacagagtgtgaaccagagtgtgaatctgagaatgaggctgaggatgaacttatgcgtgaacctgaacgtgaacctgaacgtgaatctgagaatgaggctgaggatgaatctgagagtgcctctgaacatgaatctaatcgtgaatctgagagtgaatctgagcgtgaatatgaatcggatgatgagggttccgaggacgaacgcgtagagcgtaacggttccaagtttgtagaatcggaatgtgttgaagatggctctgaacccgaatccgagtgtgaatgtgaatatcctgaatctgagcatgaggatgaatctcaacatgaggatgaggatgaatctcaacatgaggatgaatcggaacacgaatctcaacatgagaatacatctgattgtgagaatgaacctgaacatgagaatgcatctgatggtgagaatgaatcggaacatgagaatgcatctgagcgtgagaatgagaatgaatctgaacacgaggatatgtacgaggctgaaactgagccagaacaagaaccagaacccgagtcggtaccagaacagtttgtaccagaacagtcaatcccagaacagtctaccccaaacctagaacaaccaacatccactgtaaaatcaaacatcgagtctagtgtatcgtacaagcgttttctagagcgtatggactcgtctaatctcaactctcaaaagaactggagtagttattttgatgatacagtggaacagcgtgcgtccacttcaacacccaaaaagtccaagtctaaaaaacaaaagcgcatcaatgtcaccaagactagggtcgcggtaaaagagttggccaaatccaacaattggtccaagttgaaaaagctggtaaaagagtttaaagccatcgaggctaggcttgctgacattgatgactcggacgaggtgctcttgtgcaaactggagcgtaggcgcgaacgtatacttagaaaattcaaatcaaccagcggtgtcagcatcagggtgggtagtctgttggaaaagctaactatgaatctacccagacacttggtcgattaccgagaggccctagaggcgtgcatcctcaacaatagtcgtaaatcgttaaagttgccaactgtcgagactgtaaagcgtgccctgtgtttgtcacaaaacgatgcagttgaactgctcaagtgttgtatagagtcgttgcaaaagattaacggtagggatgaggatgatgatgatgatgttgacgaggccgatgaggatgctgatgttgaggatgagttgtagtttaagtgttagttgtaagaaagatttgtaatgtatatagttgtaagaaataattgcaatgtatatagttgtaagaaatgattgcaatgtatatagttgtaagaaataattgcaagaattgtaagaacaaatattgaacaaatgtagttttaaggattgtttattgatcagttatacattaaatgtaaactctaaactgtggtgttttataaactgtgttattatattattacattattttacattatttgttattatatcattatatcattttatgttattctatgaaaataaatattagttgaactaccaacttgtgatttcatttatacattgatttctacattcattcatacccttcattcataccctttatttataccaaagttgtacacaagttagggaacctagctaaaccaaagtcggaggctcatacaaattagggaaactagctaaaccaaagtcggaggctctatacatgcaaacataccctaccctctgtaggagagcaccaactctgtgtaaacacactgagctcaaaatgtgccacttttgcatatacacccagtgtatactttattgaaaattacaaatttattttcaatgaatcaaccctgtaataagacatgttgcttgttaagcgcagtgtgcatcccctatacgtcatgtcaaatttggtacttttgaatcgtccagtgtcagtcgagaacggtgcaatcaacgccaacgaactggcagaggttctgggcttcgatcgacacttgatggtcgaacacgtagacgatgcctaccaaaacttgaaagatgacgaaaccgacactctgtacattacacgcactggatttctacagatcctggctgcaatgcaccacactaccaagcactctgacctggcccgtcgtctgaccgaatccaaagaggttctctcctggatgggcttcactcgtaaacagatggagtgcactctgaacgtgcacaagattaattatcgcagccgactaacgttcggtgccatggctcgattctgtagactggtcaaccagggctttgcctatgcctacctgtgctaccctaaagacttgtgcctctttgacagtcccgagagacgcatcatcgacaagcccatcaagtatagcgtgcccaaagaggacgacgctctgatcatgatcgacaacctaaaggtggcagtgtttctgcaaccgtttacacagctcgaactgcaagagtacagagccatagccgaggcaaagggctacactctgatgacgctaaccatacgaggtccggccaagttgttgggggttttgatttacaagttgctaaatgtgtagaatgggagagagctgtagagaggtagagtggatatagatatacacatgacctaaaggttcatcacaaagagtgccatattagatgttagctgttagattagttagttgcaaaatattttaatcatttacaaatggttatatttaaacaacactattttgagcaagtgttgtattctattgtattgaactggaatgaaatgaactgaaagaaattgaatctgtgttacatctatttttattttttagcatcaatgtagccattgttgtattattacattgtcacttgctacttgttattttcacttgctacttgttattgtcacttgatacttgttattatcacttgatactatacacccactttaaagactcgtagcacgtgtacaatattctaaattcagagtataatattacaaaattcagagtatagtattctaaaattcagagtatagtgttccaaaattcagagtatagtgttccaaaattcaaactatactattccaaaattcaaagcagaatatcacaaaatttaaagtacagtatcacaaaatttaaaacactgatttaagtatgccatcacaaaatacagaattcaacattacaaaattcagagtacaatatcgcaaaatgcaaaactgagcatctcaaaattcaatgcaaaattcgaggttttaatgttgtaaattggattatgaaatatctcaaattttaagccattaaaccgcagtctgtatattgactataaatcatcatgaaattcaatctggagtttcacaaaattcaatctatacggtcgtaaacgagagtttttggtactaaaaatgcctgtgccggttcaagtaaaaatacagaatcaaaggtctagaagttgactcgtgtaaaattgaatccgttcaatttccactcgggtgttggaaacgtgattgctttgctgctgcgtaaccgatacacacattacaagaacaattctagattgtgtaaattacctctggcttcatcgaatgccaagacactttttgatttacaagagtaggttgatttacaagagtaggttgatttccaagagtaggtaggttgatttacaagagtaggtagtgttgggaataaaagacatttgaatatataggaactttgtttatttcaagtttagtacaaatcacattggtcacatctagctgtatgtttgcatactctttaatatttacaaaatctcttacaagtctatttcatccttacatgtctatcacatctactatatacaatcatatatatgtatatacactcttatacactaatatatacagtacaatttacaagtcaaaatatacaacatacaacactaaaaaactaaaactaccaccaactctaccgtcaactccaacgtcaactccaactttaacctcagtctcaatccacaactatacacgcacacgatctctctatctctaaacatcaaagtttaaaccaacaccataataggtctccacctccaccgagtgatgcactttaatccgcttgatggtaccctcttggtgctcctttatgtggcgtttgcgacacttttccaagtacgacaccagctcgggttgcttgaccaaacgattccggacaaagtgtctgggcttcatttcagtgtacaactggccagagaaacgaaacgccaactttcccaagattacatactcgggcaccttgtagtctaccaggctcgacttgagcggtgtctcccaccgatccatcaggtcaaagtaggtcctacgaggcacgctgtacatgtactccaactgagtgcactcgtcgaacgtgtacagacaccgaatgttgctgcgcacattcataccaatctggtagagtttgtgcaacaggtaatggaacacttcagccttgcgcagttcagcaaacatgcactcgccgctacggatcgaagccaggcccgattcgatgcacggacagccaacgtagtcgaccagccggtccatttcgcgctgatcgtactcggacggcaccagaatgaacccgctgccgatgtagtctcgagagtcgcaaaagttgtgcatcatggtggcatacctccaacccttgggcagagtttgtaccgccttgatgtcttcgaccaccggtttgggcaattgctccaaagacttggccgaactgagtttggcactcttgatgacgcgcagaatggccaactggtagagggatggagggcacatggttgggggctactaggatgatgctagacctttgatgataattactagaccagtgctgctccgagggttgcagtacacagaatgatgagcttatctgcaattgcaagtttatatactccaaccaccggatgttgaaaacgtgtccgtttaaaaaataccatgattcacaaaacagtcatgcataggaaaaagctttacagctacctataaagtgagtatgcaattatggataatacgctattggtggtataagaagcacgactattgtagaatacactctggtgtgcgcgcatttctaaacattcaaacatgctactattcagaggcatttcctagacacttgaaagttggggctttgcatttccgagttgttcttagttttttagactgattcaacctcctactctttaggtgctaggggttctagttttttagaagactagtgattctagttttttagactcggtatttggcaaatgttgtagctctgtgcattcaagtactggtagttttgggatgcttagaatcaaataaaactaaaaagttcgtgcattcatttattatatagatggaagaacaatacaaattcaaacagtaattcaacattcacaatagtggagcatcctaacgggttctactctatcctatctgttctactctatcctatccattctactttatccattctaacctatccattctactctgatctagtccattttacatacactacaactctccaagcaacacctccatcaaaccattctaacaatgagtctcttgcgaaagccaacatcagagaccgagtttgatttggaagatttaaccattagtctttcagactaccctttgagcaatcacagcatagtcgatgatattcaacacttgatgggcgacctctactaccagtgcaacgactcgacgtgccgatgcaagattgaaataattgtcggcttcctgatgggcttcatactgggaagcgtactggccagattgacatctggctatgctgcaaatgcacaccactctcgacaagatcaaacagatgacgagggcttgggtacgagcaccgaagagggtgagaatgcggatgatgacgacgatgactacagtagtagtagcgaagaggccaccgactatggtgccagtaccgatgaggatgacgatgacgaagatgcctcggaatggggcaacgaggtgtgtttggattaagtagtgcaaaacaggggccactgtattgcacgacaaacatactgaccatgctagtagaacccaaaccagaatcggaggctacccgtaccaaagtctttaattcaaaacaatctacaacaatctacaacaatctaaaacaatctaatacaacaatcaacaacaacgctactacaaaacctcttgagaaaaatcaacctctgattttgaatcctacctccagaccacactatacaaaccaatctttaaatcaagagccataaacaaagcctacaatcagagccatagactgcaatcaaggcctgtagtaaaatcctcacaaaacgtataatcaaatcacaaagcctacaatcaaaacacaacgtctacaatcaaagtacaactcctacaatcaaattacaaagcctacaatcaaatcacaccaaacgaatcaaaaactgaatgcacgaaaagtatatgtgtacaatatatgctttggtgcaattatattactatgctactatgctactactacaagctgcaataaaagggtgccatagagtgtatagtttacaaaagtctagagagatatacacagagactggtgttagtaggaaaggaaaaatacaagtgcagtgtgcatttttaggtgtattgtaaaactgtctaaaacatatgtgtgtgtagttgctaaatgtaaatactagatgtaagaatacatgcgagtgccctagatgtaagatgctttagatgtaagatattctagatgtaagatgtcctaaatgtaaaataccttagatgtaagatgtaagtttacaattccaagtagatacctaataaaaactttacaaaatataaaatcttgttttttaaacacaaacaaatacaacacatgtaaacatgaatgttaaagaataaccatgaatgtcaaagaatacacatacacattaaaaacagtttaactaaatacattaaaaaatgcatccactctgcatctacataaaaacacggcaaacataaagataagactgatgcatcaatcaaacaagtttagtggcataatacatgataaactgtagacagggttcaaaccactctctctctctataatatttctctcatctaatcctcgacgataatagttttattacccgacattagacgcggtatacagataaacttggcagtatcgcagcccttgtgtttgtggtgtctgcgagttctagccagaggtttgacctcttccgtcatcgtagtagtgtttgcagtgtctccattgggcttgctgacaacggtggatgtagtgtttttgtgcagagttgtagggtcgtctttgtgctcgtcgtggtcgtcgattatggtggtcgtggtgttggtgcacggcttggcaaatagatgatggtgcaacaggtgacgcttgtttcgatgtgcctgtgaaaaaagacgagcacctcgttatatgctgatacaaactagggccactacaaacttgcacactaaaacaaacaagagtgcagaaaaggtgcataggatcataatcattattattgtaaggctactcagcgtttgctcttgctgatctataatgtactgttcgaccggattcggagagtgcactgccgtttgattctttatggtgggttttaatgggaatattggaatgaggctagtggtaccgttattaggttttctgatgggttttaaaaatatactcgtagggagagttggtttgtgtgtagtagagggaagcgttggtttatgtgtactataggaaagagttgcattatgtgtactagagggcctagttggtttgttggatagtgtaggtaatgtagcagtagtagtaaaatcatcacgtgtattagtaaaatcatcacgtgtattagtaaaagtatcacgtatagtagtattaaaaacatcatgtaaagtagtagccacctctggtacactagacaccaacagctctggtaaaggttcaaactgtggtacacctctttgcactgatgctacatcaacacttggctcgtcagattgtaacagagtcagagggttaaatttaaactttagcgttcccgattcaacatttggtagagcgtagccattaataatacttccaacgccgaccgatttagcatcgataaagtactcggaaatggacacattaaaaccgccaacagtggtcattattgaaacaaagggtactgtttcatttgtcgcaacaggaactcgttccagtgtaaagcgactgttgttataataatgaaaatgtttacattcggggtcaagagagctatcgggacattgttgattctcggaacgcttgaacagaaacgtttcagtgtttgatacgataagctcttgctgatgctttacagtactggctttgttgttgttccaagtgtttagatagtgtatcaacaatggcaccaccacctctgaatgcgtataattgagaatgctacgcttgctatccaaacgccaattgtacagattgctccagtagccgtccagtgtgtcgaatcgactatcgttgccgttgaaggcaatcagcaccggtaccgtggtggccggaaagggtacattgaaaaagtcaaaatccaacgcatctcgagcattgagaatgcacacggaaaagggcaagtttcggctgaggttgccctgtacaccggacgcgtccaactggaccagtacactggcatcggaggtttggccgtgtagattcagagttgccgtctcggctcggtgcacggtacgcaccagtactctggcgtcgagacgtttcaacttgagcagcaaccgacgctcgatgcgtttactggccacggttgaattggtcaagtttaagcgcttggcaaactccaagacacgggcactcctaatgaccgaatcggtacacactgcctgttcgtttatggccgacaccgagtctgttttgtagggcagcgaagagtcggtgttgtacaagagcggcgagtcaaacattgtgactgtgcgcaccatcagacccttccaggcaagaatgtgcacaatgactgcaccgtatccgtagcccagtaggtttatcgattccgagtcaccgttgaatgcggcaatgttcctcttgacccactgtacggccagacgcacatcgtgcacgcccacattgctaggtgccaaatctcggtcaatgcacagaaagccaaacactgacaatcgatagtttacatggacaacgacaaagtcggcatcggtaaagtgcgagtaccggtgtcgttcagagtgtgcatcgctcttgtaatagtctcgaccgtgcaccacgaccacgactcgaaacctactggcggcgaccgtaccctggggtttgtacacgttgagtgtgagacagtgttcggtgcccagagagtcgccctggatgcactcaatgtcagtgtctgcgtgcatagtgtcgtttggtgaggccctgtacagtttggcattgttgaacctacgaccgacaccatagggtatccctagaaaattgacagtattggttacctgatcatcttgtccgacgagacaaccggcgtcagttttatactcacaacaagcgcaacatttgacaaggacgacaaacagactgcataccagcaacaggtttgccatgttgctatagttgctgttggtagttgatgttgttgatggttgatagtactgatgtttgatattgctgatgtttgatactgatggttgttactgatggttgatactgattgttggtagacgtgtttctagcagacggtaaactgtaacacaaagggtgcttgtattaggaggatgtatcttgttttttaaacactattggtatactatttatactactttataatattatttaaaaatattatttaatattatttaaaatattattaaataaatatatatatagttgaataaagtaaagtaaaaagttgattaaaaaactacaacactaccaactaggaatattaaacactagatgctaaacctttacaaattaaacctttacaaactaaacattgaaaattaaacatcaactctacactactgactacaacaattcactcaggaataatgcacaaatacatatactcaagaatacgaatataagaatatcagaatataagaatataagaatatcagaatatcagaatatcagaatataatacaagtaggtacaagaatataaatacctagcaattattattatacactacaaatgaaacccaagaacaagaggtacccaccaacggtaaaacaccaactgtggccgtctgattgtaaagcaaatctcggcctccttaaatagtagatgaccgattcatgtgcacatacatgtgtgtgcgataaggtagaggtgtacggtgagctataaactttacacacctagttttactcttaaaactcaggttcaacgcagtgggtatagtgctactattcagtcagtggaacactagggttattgtttctggcttttacattgtatgaatattatacacacaggcatatataatctagaaaaatcatgcatgatttatcacagcgtgtagtaattcgtcatggtcgtaaactaagaaaaccttcaatttgtacactattgtactacacttgtttgctaatgttgtaccacaagctctcgctctagactttggcacacgcagcatacaccggatcggtcaccgttagcgtgttgattctctgctgcgtcttgggatggttgactttgatgtagtaccggtccgttgtctggggatccttgtggtcgagaatcattcgtgccacctctcgattctccacaacggtggccagattgtatcgaaacacgtgcagtccaaaacccggatacggtctgcacttgcacacggtcatgtagtagcgtttcagatggtagctcaccgtagacgtggactgattgaacaaaacatcatcgataccgtagcgctcaaacgcctccagttccctactgtaaaactcggacaatttacctagaaactcttcaaactgattaaagtagtagactcgccattcggtgccgtttttgcgcttcagcggtatcgttctgtctttgcgcaacaactgccacagatggctgactttgatgcgattcacctccaccgaacgcaaccctgtatagtaggctagtagtatgggatgcgtatagcgatcggtggacactagctctttgagtgccttgaccaacacttgaatgttttccgtgtccgggtcacggttctgaggtgggttgttcaaatcaaagaccatcggtgagacaaacactttggtctcgggccaaaagagcggtttcagtttcctaaagtagagcttgaacgtggaccatttgactttgcgcaagtacatttgacgcacaaaggccagtgctctatcgtcgtcgttgtcgtactgttccagatgcatcatggccacctgtttcattagcttgttaatgtacggcaaacgtttggcgtgcttaacgtaggccgcataggctttggcattgaccagtctgactcgtcgtcgtctgagtctgcgtggtctgtttcgattgttggcattgttgacgattccactagtattggcatcggtcatgtcatcgtctccgtggtacgtttcgtgggttgcttgagctacactttgctggagggatgtcatgttatgttgaagtttccggctctggctcacacaacggtgcaaacgtatgatacgtgtagaggataaagtcacgattcagaaaaggcatacacgccaaggttctgtgaagttccaactcttgctgaatccaattgttcttgtttagaattagaaagatgcacgttacaaaagtcaagagtagaattagaccatgcatcttagcatggtgtatgaatatgaatgaatatgaatatgtgtatcaaacaaaaagactaatctcttgttgaaaaaaattgatggattactttaacatttttacagtactagacatttatcaagtattattaattattaaacattgctaaatattaggaaacatggatcaagtatttattaaatgtagctactaaaggtatttgctaaggatatctaaaggtatctactaaatgcatctactaaataaatgcatctactaaggattataataaacacactcacaaatcaggaacgatactgctaccgagacttgagatttactctgtttacttttgtacactatatcaagtgtatcagtgtggctcatactcatacacatactctaacattaaatcagctgcaagtatagttgtactttttaccagtatactttttacaagtatattttttaccagtacacttttcaccattgcattaaactatacttgaccaaatcactacactctttacatctgagttcccctcctggagcccctgctgcggctgcgtgagcgagaacggctcctgctgcggctgcggcctctgccagatcgggcagtgctacggtttcccgaacgagagcgagaacgcgacctggatcgtgaccgtgagcgagatctacctctgggcctgcgcacctcgcagctttcgtcaatttgacaagtttcaagagtcattgtgaatagggcactctctaaactagacactgggtgcatacaacaccaatacggtattggcactatgcaccacaatagcaacactttacatgttacggaaatgtgccaaattcacacaatccgacagcgacagatcaaagcgtacactcagcgagtttagcgtcttgaagggcggttcagcttcggcaaaacccagtctgcacacgaaccattcgtggggttcgtcgtctacgaggatgcgagacgatttcacggtagccactcggtccaggtcgtagcacagtgtggaaaatctaaagatgcactgcacactgaaaaagtgaacgtaaacgccttgtccattgtttatagcaaagtgcatgcgtatgcgttcattgttgccgtcgacgcctgatgttccgtaacacactgcgttaaacttgcaccggacgcaagattgctgttcgattacccacagtcgagacggaaacaggtcgtctacgcacatggtcggattgtcatacttggacagggtcacttcgcattcgaatccctgcgagtctacgagacgccagtgttgacgctcaaatggaatcttgataatcttggtgcacatgttttccgacgctcgcttccgtatgattataccgttggcgtaaaagtcaaacttgtcgcatttgctctgaaactcgatcaattcggagctgtccttaaagttttctacgataaacaatcgaccggctcctttgaccttttggttgcgtatggaacgcctaatctttttcattagtgtgtcttgagtgcatctagcctttacttttactttaggtttcagtgatgaggattcagagttagtgtcagagtcaggttcaggttcagagtcagattcagtatcagtaccagaaccagagccagagtcggtatcggtaccatatgcaccagattcacattcagatgatctggaccttgttttacgttctgcctcagattttagttttatagaatccaagtgtaattgcaagtcttctcctggatcaatttcaatgtattctgtgccgtctgtggttggtgttgatgtatggtccttgtctttattctcagttgtgcatgttgaattgttggaattgttagaattgttagaattactagaattactagaattattagaagttacatcaacctcctcatcatcatcttccttgaaaatatctcccccaaagggctcatccgaagtgtagcaatcggcaaatacacgtctggccacatccaagcgttcctcgtacgtattgtccagtatggatttaccattgaccagatagagatccaacagtacaaaacaataggcttcatcgttgccgttgatgcatcgcgaactcgaagagtacgatcgcagacaacactctacatcggacgtaccgtagcccatgagcataaactctccgcaaaagtacgacagacccttgaccgagggcagtgctcgtaggatggctctattgttgattcgcacccgtacaccgtgcctgtttagcatgtagtacttgcagtcttccgttaggcacagacacaggtggactcccttgaagctgggctgtacgcaatagtcgctgcacatggcgtccagatcggaaacgttgagcgtggcctctgtctcgtaggatacgctcggcagtttgtagtaggccatcaagttggtgtcgcacgtaaagacgctacgtgccacgtgaaagttgtacatgccgtgaaaaagatcaaacactatgggctgatccttgatgtcgttgcgtatgccgaatcggtagtattcgggcagactgcgagtcagatcgttgacggtcacattgagactcatcgacgatataatgtaggcctctagcggtgtgcattgcttcaagattaaatgatgcggtgtcttgaacaattgtacaatggtcagtctgtcgtcgttggtttgttttttaggacaataataattactggcatcttggccgcactcttgatagtttacgtctagacgttcaaatgacgcacactgttgactacggcgtttattgcaaggctccaattttacagtgtctataaattcaattttactacaaccgcttcgaaacactttatcgctatagtagacaaagccctcgtcctgatccactagtagtttgcaaatcagtctggatgcgtcgtcgtcttcgaacgactcatagtcacacttgccaatctgttggagaatctgtttggatatcaggttgccccaacgattcaaacatgcacacttgtcgtgcatattgatgacaacctttttggcagtcctccacgttgcgatgagttgacgacgccactttttgtctataaacaatcgtatgcaacagtacatggattcggcatccatgctggtcagccacagagttagctgttccgagtttttagcatagccgttgaggaatcggccaatctctatgagtgtaaccattgtgtttatttctaacggataagaaggatggtaaattctaaaaaacaaagtcaacattattctaaaactatattctttaacaaatttaaatacaagtgtaacaaatctattaggtactacaacaaatactaaatactttgatactttgataggtgcctacgttcaacttgaaacacacacaaatcaatttaaagaattaccaccagtactagtactggctctatttaatctttccattagatttaaccgctcaaccttgttcataacatctgcgctatcgatccgactacgtttggccatgtacgcctcgtagtcaggatcgcgaatcgtactcgcatcgtactcgtaatcgtccgagtctacgattcccagattgctgggcactctgtacggcgccagtagaggatacggctgcggtccgaatgccgaagtgttcaaaacctccacccttggcggtagcggtcgtttgcgatcaatcaacggtcgatccggtttcagatggattcggctgcgattgatcgcatcgatgatggcatcagttttcgaaacctccttgtccgcgttcaaatcgtcatcttggtagccctctgtgaacatggataaggtatcctgtacgctctctcggtgcacaggtcgtctgcctttgaatctttctgcagttccattgtttgctacattgtatgacacattattcacactgttaatactggctgcattgtttgcaccaccgatagcagattctttaataaacggcttgtaactttgttcgtttatcgtattggtgttatcgctctgccgagtattgttgtaatcgttgctttgcacgttcaatatgttcgaatcgttttcgaaatccaaagttagattagagtcgtcggcaaactctgcatagtcgtcgtaaatgtatccatcctcttcgtccacatcttcatcatcgtcgtcgtaatcttctatctgaggcggtaccacaaatggtgtactcggacgtttacgggtggtttcgggagattgaggtttctgttgcttggacgattgaggcatttgttgcatcggaggatgttttagtagagttgtagattttactgatattgtaggtttctgtgttggagtgggaataggtttggtagtgggtggtttaggaataggtttgatggtaggtggtttagtaggtttaagagtagtaggttcattagtggatttagtgataagtttactattagtagactttagagtatttatagctgccaagttaggaatgggtctagatgttggagtagtaatgggctcaagcttggctactcttagtgtagggtcaagtatacttgagggtactgtatttgaatctatacttatacctgtatttatacctgtttttatatcggtatctgtatatcgagactctctgactcctcgcatcatctcatctttcaagttttgtatagtctcattatcaatgccgccagagagtccgatattaccattgctgccagcaatcccagtattgctcatattggctccagtaacagcaccggtaccagtaccggcactctccgatgcaggcgtcattttactaaaatcgataccggcatcgagcagtgccagtctcagcaagtctccggggtccattggttttctaggtttttcattttttggaagctttaaatttgtatcaaactctgtattggcatccttgttgttgtagttgttgtagttgttgttgccactaccactttcaaaattcactagattgaatgatgcattgtttgcattggatggtgcattgtttcctttatcgtcatcactgtcgccatctcctaagcctcctcctcctacatcctctgtgaatccatagtcttcatcgcgcagcattgtcaacaatagattccgattgacaatctttagcttgatcaaacccaacgatgtggtcggtgtgtccataatgtaacgcatgtacgattccctaagagtcttgttgattgcatcgtgcctaaccgtcaccattttatagtctagtggtataaagtctatcgagtcctcgtccatggccaatggattcacttgaaacgtaaagtgtcgtttgatcaagagtgcatgtttgatcaccggcaataggatcgtgtagagcggctcgactcgtctgagcacatattgccggcgattggccgtgtacggtgtctgattgattaggtgcgtgtactttaacgattccaggtgtgcgatcggtacacgggtgcacagatggaggcacgaagcgatgacggtatcgattgtgcgcaaattgaccatgcccatgtcgttgactgtaaacgttttaaactcttgaatcaatcgcacaagggtgatggtaaagtttttaatcacgctaccggtcagagttccgctcttttgttgcaacagtccaatcttgggataggtcagagtgactcggggattgagagacttgatcgtggtcaatatgctaatcttgtagttgtccgtaagtttgggacgctcctttgtaatttgctcaaagacgctctttatgttggaatctttgagcgtttcaatgttaatctttagatcgttcaagagctttaaatgggacgcctttacgttgctcattataaataatcttgatgtaaataatcttaaataacagtataatttagatcctctataaaattagatatcttttctaggagagagaaaggcttcaactctctctatatagttttgcccggaaatgatgctataaaaagggaaacaataaaaagcaagctgtaaataaatgttgtatctagagaccgagataagttaaattataaaattaaataaaaaccggataataaattatcaacggcactctaccattaactaatctgtattatgattattattattaacaataatagccacattacagttttacaacctctgattagaaattgtaaactctacagaatgaataatatcaataaaagtatagatgtagtagtagatactacacatttatgctataaattaagttacactgtagtcaatgtggtgtaaacttgtctagcaatgggctcggttgcaaattgatattaaatattattattatcaaccaagctacagtagtagtgtagtatagttgtagaggtttggtggggaggtgattatttctcacgacttctcaataacaccactagtcgtcgtctgtcagcagtgttaaatggactgttggttcggtgtagttattattatacttttagtgtaggtcggtgtcatttttaaatagccatataaacgttaaatatcataaaagcaataacctattgaggctacgtttgcgtactaaatttaatttaaaaacagtgttttgtgcacatcatcgagatgaatgaaattgagagaatcgaaacttttacgagctccaactggaaggactcgatgattctgggtatgaaattggccaaaactggtttctatttctgtggagcaaatatattaaagtgtaccttttgcaagtgcatcctcttgtggaacagcaaagagtaccaagagtttgtaaacaaacctcaattgatacacattcgtttgtcaccaacttgcgagtatgcgtacgcaaatctgcccatgtacgctaatccccagtatcggtatttcaagtcgagactcgattcgtttatcggcaactggagcgtgttcaagaggcccactccgatagcgttggccgaggcgggattcttttatgctggcatggtcgattgtacaaagtgtttctattgcgacggcggactaaacgattggaacccgtgcgatgatccctgggaacagcatgccatacactttgaccgatgcgtgtttttactgtacaaaaagggcccactctacgtagagtcgataaagaagaggattctgggtgagttgtgttggttattgctattgttgtcgttttaatatttagtattgtttttaacatttataaatgaacacctgtacttgtgcacatgtatcgactaaatttacactcttatatttatactctcactggacggtaattaaattgctgcaaaaagtagaataagcgatcccttgagtgtgcatccttcaagtgtagataaattaaattaattttgtctataaattgattttatctataaattgaatttgtctttaaattgatttcatctataaattgagtttggttataaattgagtttgcaataaatttagattgtcgtaaaccatttcatctgcatcatttatttaattcaggcatataaaaaaatccaagtcacatttaatctaaactatactcgctcactctctctctctgtactgtatacattccacctctgcataatacacacactaacctttgtaaatatttaaacatcccattccatgtccattcaaggtggtggttgtggtgcagactcctcagagtgcaatgattgccaatttgacaaagctggcactggagagaatgtacgacgtggacaatcttgcagcacggatgccgaacctgtacttggttcatttgagtacactgattgcaatcctgctgatactattgctgccggcaatattgtagacttgaagaatgtccgatacggcagcataaacactagcgtctcttcagattgctcagaggacagtagcaacgtgtacagcaatcgggcaacgattagcgcaacgcccgtggtcatacaagactcggaggatgagcaatttatggatgattctaaaagtgtacacaaaggctctttcatagagtaccgggccatttctaaaaatgaatacaaccagaatgaatacaaccagaatgagtacaaccagaatgagtacaacaagaatgagtacaaccagaatgagtacaacaagaatgaatacacttctaaaaatgactacaacagtactatgcgcagatgcaaactgcaccgagtcaagaggagtattgttgaaagctttgaatctacagatgcgactcccaatgtagacgttgacgctatggagagaggtagaggtgctagtgctatcgagaaggctaacactatggataattccaacaaggatggtgttgtggaagagtcgattgttgttgttaatggtagcactattgatggtagcattgttgatggtggcactattgatggtggcattattgataccagcaacgttatcgaggcaagtattatagatgtggactcggaggtatcacaagtgaacaataccaatacaggatctggcaatgttggagttgaatcaagtaatgtggagtcaaataatgtggaaagaagtaatgtagaaacaagtaatgtagatgtaaatgtggatgccgaatcaagtaatgcagaggtagatgtagatgtggacgcagaatacaccaacaatgatgatgctactaatgtaggagagactactgaagataatacagaatataatacagatgagactacaaatgaaaatactgatgaaaacacaactgacgatacagatgaacatactgatgaaaatactgatgaaaatacaaatgaagatacagatgaaaacacagacgaaactacagagtacaacacagaggactacaactctacagacgtcaatatagatgccagcaggattgaaacaatcaacactagcggtaactgttttgtacattttctattgacagacactcgtttcctgaattacacattgtcaatgcacgcttccttaatacacattgtttatacatgcatgtacaaataaccattaaaattaacctcttaacaaaaagtaccatgtaaaacactctctccctctatcctccacagatgcatcgaccaataccaacatttcgataaactccaatttatcgctcaagcgtatgattcaacgattggaaaactctgacattggacgtcgtgcaagaccaccgacaccagagcgctgcaatgtacgcaatcggcctcggataatctacgtagacgagaccattggtgagttgtaaacgtccctttgtgcattaccaaaacttgcaagtaaacttgtaatttcaattgtagaacaatattgcagccactactgttgctgctgctaatgtttccactttagtgttggacccttcaaaatgttcaaactataaccgagccagaccgtcgttaatttataccaattgtaaatgctattacaataatagtagccgcaaggatagttgacctgattcagagggtgattatttacacggtatgattagtgtgatctgctcttagcaggtacttggttgataaatatgtgtgtgcgtgcatttgtttctagagcaatgtttaaatgtaaatgtaaatgttaatataaatgtcaaacacctataatatacatctttatgtgtatagtaaaaagatgtttataaaatcagtgtacttacctatatgtatatcaatttgaaatctaaatgtaaccttctacaaatccatctacaaatccttgtctttacacatttcatgcacagtttaatggttcagagaattatgtccagtgtcaaatgtgtagacgttagtttagtatagggccatgtataatattctagactcttgacaccaacaggtttgacaataaatccaatagtcatgccggctagttatagtcaaataacagtcgagttataataattctaatttattgttgttttaatcatttactgttagttttggcacgttatggctagttactgctagattgatcatttactgttagacctttagtttaccgttagtttaatttacttaattagattactgtttggtgttgcatttgttgtgttttgtgtttgcatttgcgtgcgtttggtttggtttttgcatagagggtctttttgtgtatacttgcactaaatgtatgttgtacatacttgcaatgtttattgtgcactcttgtacaaaatgtatgttgtgtatacttgtaccaaatatttgcactctcgcaccaaatgcattcttgaatgtaaaacatgtatattcttctcatacaaaccaacctccatttcacagatgccgatgccgattctaccattgaagatgaacgttcaccgattgactcttctggtagtttggttaaacctaacaatgatgctactgctactacttttactgaaaccactaacattagtactaccgccaacattgatactcttcccatcaacactgatactaacagcaacgacacttttaacaatgcatcaggttataatacatcatcttgtaatgcatcatctggcaatgcatcatctggtaatgcatcatcatcaacttgcaacacaaattacaatacaaattacaatacctcagactataatgcatcctacaacaaccacaactcatcctataacgtatccaacaatacaagtacatacaagcacaaccatcaacctcagtctcaacctcagcctctgtctcagcctccatctcaggatcaacctcaaaatcaacctcagtctcaccctcagcatcaatcacaatcatcccagactataacgttgcacactgaaactggaacgatagacctttgtactgcatccgaagacgaagaggatgaggatgcaagtgactacattgacgacgaaccctactacagggacgattgcggtaaagtgatttacatcaacaatagtggcccattagagtgtagcgtgtacgtggacgaagactgcacctcggacactgaaccacggccagagtttaaaactatacagattgtcatcaagtctgaggatgtgtccagaaaggccaacaagtacaatactcaaaacagtaccaacaattttattgcaaacaatactactggaatcaataaccatagcaacaccaacactaacaacactagcaagtatacaaacattgacaattttatgcattttcatcagtattacaaaccacaaaactatagcagccaaaaccaggcactggatcagatgcacaatcagtttaatcagattcagtcgtttaaccagaatgcaccctttaatcagtataaccaaagtctggcattcaacaaccaatgcaccaacagtcaatgccagtgcaacatcaacacttcctattatgaatcttgcaacgagtcggaaacctactcggatccagaatactatgatcaggctccagactactctgaaatcaagactagcaacaccattggctgccagactagtgtcgagaccaatgtcggcatcacgcagacggacgaggaccattgtcgtctgatggatcggtccacacaaacgttgaccggtggtaataattacatgccatcaaactcttcactggactcggcctcatcttcatcgtcttcgtattgcttttacaatcgcatagattcactaaatggcgttattagcaattctataaacaagtctatcgaacgcaccgcactcctttccatttccaattcgtttgaacgcactcctccaccttgttataagcctcctccccggtactcatccccaaagtttcttacagttgacgcgtccaccaacacggagattcagaagatggatcagcatcagcaaacggacgcatcggtggtggtggtgtaaccaaggttggagtttgaagttgacgtcggtgtaattgttacaagttcaaaacaacgggatatctaaacacagtttaaatgaactaatgtttttaatgcacacaattgtagatcaaaaaactagaatgattcaattaaaactacttttaatttcatcttgatcattttcacactattgtaacttgtctctacatactgatccttttcagactactattcagactacttttcatactacttttcatactacttttcatagtactacttttatgctcattctgtggtggttgttaattttagattagtgtcttagaataggttcagtttgaatttagaattaaactatatttagaactacagttagaaatacagttggaagtgcatgtttaaatggtttacatttagtaatacacaagtagatttagaaatagagttggtattagatttagaaatagagttgttattagatttaaaattagagtataaattaaagtataatgtagatttagaattagccattaaacagtgtggttagatttaaactcaaaatgtacttttattataaacacaatccatctactgatactacacacatttataaatcaacttcatacaaatacatacaactgcatataaatacatataaatacatataaatacatgtaaatataaaaaggtacactacaacacacacctcacatttacaagcctgctataaaagctaataacccctcagtcacttgggtactctttttttcaaagggtgtaaacaaggcgcgtacaaaacctctaacactagtggttctgcatactacacacaataacaaacactgtgggccacagtatcggtaaaatgtcgaccgcctccgctcatgttgacttgacgcaatccctgttgctgtaccgcaatattacaacgagattgaagagtttctcgagatggcccgtcggtctgcaacagtgtccagtctcgttggcagaggctggatttttttacagcaacatgtgcgacgaagtgcaatgttacttgtgcggtgtacgaatctcgaaatggctaccggaggacgatccgtggattcagcacgccaagtgttccaaaaattgtcgcttcctattgcgaataaagggtgtagactttgtgtacaacattacaaaaaactctacgtttatgcacaagactcagtcaaaggccaactttgcgcggttctttatcaagactgcggtcgttcaagacactgcggatcgtcagggtgagtgcctgctgtgctgttcgcatcgtgcagatattgtgatattaccgtgcaagcatctcgtttcgtgcggctggtgcgtgaccaaacagttggacaagtgccccatgtgtagagggccgactgcagaaattatgaaaatttacttttaatatttatatacagcttatcgaccgtaacgcgtatagcctattggtgttataaacggttcacatttatgtagttctgaagcattgcgttgcgagcattctcatactttgcgtgtgagcatactctttaaccttttgcatttgacgataatttaactcgacaccatgaaccgcgtaccgaaaaccaagtccatcacccaccaggagctcaccgattacatgtactatgagagtggagattttcagacaatcttgaaaatcgactcgttcaacaagactttgtcgttttacgaacgcatacccggtgagcttgtagaagatctaaagccccttcattggactccggcctgttttgacgagtacgttaaagttatcgatgccgtaataccgggagtgtacacttttgacgttgtcgtgtacaatggccagcagttgcacattgtagatttactatcggtcaacggtctggatattgaaatgtttacgtacaccgatcgcttggccaagattgcaagtctgtttgtgagcaagccgcccatgcagattacttttaaatcgctgccgacaagcagcaacaaactggaaatgtacaatggcccgtgcgattgtttgatcgtaaaagagctagtctcactaaagtacaacatggactacaagtatgtaacgcctcccaaagtgtacaagattgtcggctgtgcagacttgattcagcgacagtacaccaccgatgtggccagatggcgtagcgttgccaatgaactcgaactggaacccggctctgatcccaccaagatttcggccagttgcaagagtgtgctcatcaagacggccaaagccaatgaggtgctgcgcaacattctgacaaaggtcactgtcaagcaggtgcacctggttgccgatgccaagaacctcatctttggctattgcatattggacgattccgtactgaagcacgcacccaccgtcaaagagtctaacggctacacttggatgatggccgatcacgatgaaaagtttgccaacattaaatacttcaagactcccagtgtggcatcgttcaatcacaagacatctggcaaaatggaaatgtacaagctgcagatgcaccggttgatttgcgatgacagcgagcacgttgtagtgtccaatctgccggtcaggatgcgcatagtggcagccagactgtccaagagcaacctgtccagtttgattacgatgttgattgaaaagctgcacttggtgcactttaacgacaacattgaagagtttacacactacattaaaatgttggaagatttattggacaagatggaccaccaaggtggcggcggttccattatgagcactacgttgccaaagaagcgttcccattctagcgaagagaaggacaaaaatagcacagcttccaagaaggcggacgttgaggaagctgaccatgctgaagaggaagaggcggagtctgagccggccgataagcgttctaaaaagtaaatgtgttgttggtagagttttagatgatgtatcaataaattcaatagatgtgtgtattcaataaatgtaggtatcgatagatgtgtgtagcagtagatgtatggattcaataaatgtatgtattcaatagatttactaataaatgcatctagctataagtttagagaataggaatgaatgtagtctttaggttagttttagttttttggtaaagtagatgtaagtagggagtaaattaggaggtaaagtaggacgcaaaacatgtagtagagtaggcgctaaagtatgtagtaaagtagttgagttaagtaacctagaataaaggaatcgtaaactattacaaccactgctacctattcaaactttgacttgctatttgaatcttactttgtagtatgctgtgtgtttgacaaaaaccactgataccttttgtcttgcaactttgcattgaattagggtcgaaatgttaaaggattgtgtgtgcgtgtgttttagttttttagaataatgatactttttattttttagaataacaataattcttgttttttagaatactaataattcttgttttttagactaacagtttgatttaattttttagactaacaatttgatttaatttttttagactaccaagtcataaataaatatcaaaacacagttgtggtacacgtgctgggaatcggttacgtttattaggttaatgtgcattgcgtgcgtgatcagagttttaattaaaacataatgtcagcgagagagaaatctattagaggtgtttctaaaatgtaaattataggatataaaattagcattagcatatagtctaagggaagagttgtactgagagatacttttgcaaagttgtaccggatgcattgttgtgtgcacatgtatttaccagtgtcctgtttgttcacattttactgactagtgtagtagtagcgttattattttagcattgttgcactgtattgttgctgtttcatagtaagagtagtacaagtctctctgacttgagctttgctttgcacgattgttttgactgttctttgaattggatttggtgttactatgtaggattaagtgtactggaataaaattaaaagtattggaatacatttaaaagtactagaataaacttaaaagtattgtaataaaattaaagtactggaataaaattaaaacctgttggtgataagtttggtagattatgtttttttgatagttttaatattagttgtgacagttttatatagttgtaacacttgcagttggcaaagctataaagacggcttgtgatgtaatgtttatttgctaacctaaacttgtagagtacgtaagtaaataagtaagtaggtaagtaagtaagtaagcaactgtaagtacacaaactccaactcgtcattctatatgtttttgttgatagaggtagagagagaggtagagcacggtatatcaggttctaaacaagccaatcacttgtatattaacttataacatccaaacgagtacccttattgtaaacccatccaatcctagattacttgctacttgcttgaataaatgttgtgtgtagtataccaacacgtttcatttcaaagacccaaacaaccttacttgcaagtctacccaaagtgcccatataacaaatatccagaaactataatgtccaacaaaagtggccgttgatgggtttagataagcttacacctttccccgggcaccataacatttacgatttccgtataatgtaaattacccgaccgttacctactttatttataggcgtgtaatttattagcattttatgaccaattcaacaatttacaacaacattaattagcattgtaagtttgtattatgaataagaaaagttgatctgagcacgcgcacacactgtattgtacagtgctgtgtactgttgcaacaaagttgagattgaaaggtcaagtgtaaacacacgttccgtgcgttgaacaaatgacgagtcattggacctgtaatgagtctggtgatgtgggtagaatggtagatattaggtagcagccggtagcctttttgagtaaaagctgaggaagtagatgtgtttaaaaaaagaacaaagtattacttgactagtatatatatttatttaactacaatttagatacatttatttaaaatacatttaacattaatattcatattcatacaaatctcatataaaactaaacctctagtaaagactacctcaatcctcccatcccttcataatttcatttacacgcaaaaaggcagccatcgagtctatgttgtactcggccatcgtgatggttgcgtgcactcctcgctccttgacgttggcatcgtagatggcctttgagaggatctgatagatggtagtgttaatcttggacacaaacttgtacagattcaactgtgaaatgtgcacatcgttcaagtgatgggcagcctcaaagattacatcggtcggtttgtttttcaagtaatgaaagtatttgacttgcttctctccgaatatgtaatcgggctcgtcctccacaacggctcgcatcatctttgcaatgggtgtgttggcagtgtccaccttttcacgattcgtgctcatcatgcacagtactacgctgcgatctttgcgtgcacgctctgcaatgtacatgtacacctcgttgactagaatgtcttgtagcatctttgacgatatcggtacgcgctcaatcaggtagcgctcggccagtgtaaagatgacatcgttccaaatggtgggaccgttcttgtttatacctctcgatatccattcacccttgcacttggccagatagacctttttggccattataaagatgaactgatacatcttggcggtcagttcgagttcctcattcagagtcttgcaaaactcgggcagtggattgttttccagattcgagtcaccattgtgtacaaacactgaatcggtatcgatcagtactgccttaaagttttgcacatgagcaaacctggccatgtctataatgtacttgcgtcccagagtggtgagcgctgcagccaccagtctaccgctgagcgctccatagtcggaacccaagagaccatagtagctgcagttgacaatcttcaagttgcgatacaacgagttgattcgagacagttcacccttgagtttaacctcatagtcggtcagcaattgaacatcgttgcatcggttgatttcgtcaaaggttagcagtttaaacttgggcactagcattttcatatcactactcttgtccacatcggcagtgttgaatatagagccagtattgcaaagttccatattctcagggttggaggggtcgtcagtgttagagtcggttttagattcagtattggattcagttttagattcagtgttggtttcagttttagatttatcctcagttttagtatcagagtctttgtcgtcctctttatcctcatctttatcctcatccttatcctcatcctcgtcctcatcctcctcctcctcatcctcatcatcgtcgtcaaaatcaaacacaacctcttgatagtcgtcgcctctattctttaccgcatccaatcgtatctgcacctgggtcaacatggtctccatttcctttttcaaatccttggctcgagatcgtaaaacgttttgtttgtgaatcatgttgcccaatagagacggttttcgctcaacgctcaatattagcacacgatcgttggaattcaagtttttacaacactcgtccaatgaactaaattcatcgcaattattctccagcatattgatcaggttacgagtgtttgcatgatttacgacctcttccttggaacacttgtgcacggtaaatgtgaaatatctgcacggatggtttggattcagaatgggtctgagtcgctgcagtacgtgcaccggaacgattgcgatcgtttcatatgaaatgttgtgaccctgtttcaatttgggataataggcgaccacatcgttcactttacaattggtaaacacttctcgggcgatgcgcatattgaatcctccaccgtagctggcctcgttcacgcccgccgacacttgattctgattgtacgtgtacatgacgctaccgttggtggtgatcattagcccgccaccgatgctcttgtgcagtgtcaaaatcttaccatcggtcaaactgctgtagacagacttgttgttgataaactctccaatcttgcactgcgtgtaccgtacaatggaaatcaaatggctcttgcacagcttgggtagaaactcgtcgtagctgagcgagtcccacagtcgacacagcagctcggtatcgacatcgttgtagtgcacaatggtggccaggtcaatgttaaacttttcaaagtggcactcgtcattgggcaggcctcgttccaagaggtgccggtacacgtgtcgaatgttgatggcgttaaactccaccttaccctcggcctgacccagacacaatttggccatagtgtccagcgacagcttgcccacctccggatagagttgacgaaagattttaatcaaatcaatgtgaatcatgtgatttccatacactggcatgcctcggtacagggtaaagtttttaaactcgggcagacacaggtaggcggtgcgtttaatgagaaaagtcatatcgtaacccttgctattgtagcccaatagaaaatagagcctcttgcgatccaacgtctgtaggatgagccgaatgagatccacctcatcgtgcacgaccaccagtttgcgttgcatgttgcgagtggcttcaaagtctcgctccatcaaactctttaggcgttccgtataggctcgtaccgattccgagttggcatccaccgtatcggtttgttccaatcgtgcacgtttggccacagtgccactaccagtagtggtgtaatcaaaatccacaggcaccggtatattgacaaaactgtacattgtgttggtgccgtgatcctttatcgaggctgaaaacaaaatgtcattcttatagtctcccaggggcagtcggtaatcaaagctggatagagtctcgatatcaaaggccacaatgtcaatctttggcttgggcaagtcttcgtagcgagccagattggcgtcgacaaacacatcgtacaccgagcactcttccagactggcctgactcgtacggcacgccatttcaaagacaatcaacagctccagggaccaagtggccgtagtcttgatgtgattcttcagagcggtcgtgttcaagagtttgtgtaaattttgagaatcgccaaagctacaggtgggcacttgaaatgtcttgtactgaacgctagtcgtttgaatcaacgtatcgagcagagtattgttgggaatctcaaagttgaacgaggagagctcgcgtatgggccgctccaggtcaacgtgtctgagattgagcaacggcgtcagatgcatctcgttctcggcaaacacaaagagcgaggtcttgacgttgttgatcattagctttgccgagtccccggactcgtctacaccgaacgcgtaaatctgattcttggtcgatgcccaatcgaggacgtagactcggtcggtccattttatagactcgtccgaaatcttgttgttgtaatagtgttcctcgtcagcgtacatcatcgtgactactaaaccacaaaacggcgtcactaagcttttatatacaaacactgataagaaattgcatttaaaaggcactacacttgcaacgctaccatcattaatatagcgaattctgcaaaggcaatacgctattgtgcttatctttgacgctagtttattggtttatgcacatttttcatcatgccgatcagaaagaatctaaagtcgatcatttcaaaaatattcaagaaacgcttcaatgccaagtctttggagtcgatcattttggatgcattgagcgacgtgcaccatgccagggtgtcgatgagcgatgccaactcgcccttggattatgtggactcgttgagggaaaagatttgcgcctaccatattccgaagcatttaaaggccaaactctttcatcgaactctgccgcccgactactacctgtgtccgggcgtcgaaggcgtctcgtacacgggctactgtaagcgatgcgatatccagtatcgctatccgaatccgttgtcgtcgttgttcaacttgtcgaatctctattgtgtagagtgttgcggtgacttgtttgataggattgatgatttatacgtgttttgaggtggagacggtgcggttacttgttgttgagattaatggtgctttataatgtgtttttagattaaagtattatttaggtttttattacctagttctagttatggttgtacttagtttgtacaaataaagattttaatactcaaactgttgtgatttatatttttttagtttaccctgtgatatacatttgcatcaactacatcttcctactcctcatcatcaacctcacactactctacatactattctacctctgcaatcctcctactctttcctttatagggatgcatccataatcaaatcaaaaccaaagtctcagtttcattagcggaaaacaacatttgacttgtaaaatacagactctgggaatccattggattgctttacatggactgaattacaatttcattatgcatctacattggcaggtatcgatcaaaagcttaatttactgggtgtctggtttaatttattgactagctactgctcggctgatgggctcatgtttatgggatcatgtttatgtaatgacattttgagaattgtggtaaaactagatgttggaggctaacggtacggactcggtggtgatttatagagttgaattagttacgagttgaattagtctaaaaaaaatacaaaaacttggtaggtgcatttaaatacatgtaaatctctacctgttatctaaactttaaactccaaatctaacctctaaaatctctgtatgaaatctcagttcaagtctttgttaaaatccaaaagtatatacacatttgaatatccactgcattcaagttaaagattctgaatttaggttactctctcggatttttaagattctacatttgaatactctcaggaatgaaaacaactttgtattttaatcttggtttttattgttcagtttattaggtactagtagttgtgtgtgttttagtatttgattttactactattatattatgctactatattattattactactgctactatttactactatagtactactactaaaactagaaaatttacagcatttcaaagtgttacatttagtaggaaggtgcagggcagttaaacaactaggttgctcttaaatactagttacgtatctctaatactaatactaatactaaatcgtatacaaatcaaagagactttagtcacgagatatatattcatcaatcaatcatcacacaagctaccatgaaaacgtaggacactgcactgcatcaatcttgtaccgacgccacttgtacgatgcgatgcgggcacgagtggtcttggtgcattttctaaccttgaccatgttgagcgcgtacaagtctgaacactttgacttgtgctcctctaggacatcctttaccgattcgttcagttggatgctctcttcgaacgtgggcagactaagcatcattgcttcatcgtcggcaccactgttgggatccgcaacgacggtgttttcaaactctacactgtggaaagattcggcgcctcctttggatgcactctcaaagcgtgcagcactcgcagtcggcaacttgtccaataccgtagtctggatcggtctcagtctggtcagcactcggtagcagcacttttcctggctcggtatttgaggattgtacgtcatggtggtttgtgtttcgatgcttgatttgtataaaactaaactccaactttatagtcaacgcaaactttaaattatacactttaaattcaaaattaaatcaaaaactaaatcaaactcataactgaaactagtacaacacaaatggaaatgaagtgaccatgacagaaatattgttacctaggcacagaggtaattcaaagtagtaaagtaggtacaatatgatggaatgataataataaaagtctatatttgaaagagcaacatgtgctctttgaatggtttgtaatctaaaaaactagagtccaaacgcctactgaaattgtagctgcaacacaacttgtgagcaactaaattctcagagcaacgggtcgagctgcacgatgattgcactctatttaaaacaggcgcccattatagtacagttcaagtatagtacagatcaaatatagcacagaccaggagtagtacagaccaggagatgtacacttgtcaaggtttgtaggtcaactgaagactatcgtcaaatgttttggtttatatataccgacacaggatgtgacaccaaagggcgtgttgataaaccatttgttaattatagtcattacacaatgtattagtgctcagtaccacatcctgtatgcaattttccttgatttgtaaaatctattctaaaaaaccacagtaggtacaattacaagtaattaaaagagtcgttacaactaaacatgaacaaaagaggcatcttatagtactacaaacaaagtaatgcaaacaagagttgaaatcttataacctagcacacatgggagttttaaggaatctaaccaatactaacaccaacaatctttactcttaattaatactagcactctaaccaacactaatactaataccaacactaatactaatcaataccaatcaatactaataatactaaaacaaccactcactcggcatcctcctcgtcctcccctcgttcactgtaaatgctactgtccgcagtcatcaccgagcccatcaaacgagacacgtcaaacgcaatgtccgatttaacggtggatgcaatcttgcagttctccatcggtgccattataatcttttcggcatccttgttgatcttggcctctaccacatcgccatcgtacaagtggtcctttttcagtttcttgtggcgagtgttgagcaccgggaatgtcttgtttctacgcttctcggcactcttaccaatgttcataaacagagtgcctctgcccaggccactggtgcgcacatacaagtacgtcttgtcagcctcctctttgagcttacccgaccaaatgttaatcttgttgattttgtgcggtataatctttatgtagctctgcggcaactgatccgtgggtagacagtttagacgatccttccaagacttgaagtccaactgcacctgattcactgcacgcacatcgaaaatctcactctcaccgtctcgggtaaactttacaatatcgtaaatcttaccgtccagagtgtgactctcggtggtcaaattcagcggtgtatgagtactgtagccgtacacggttttggtgaatctggccagagtgtcaaagtgcttcaaatctatgggtagacaatcgtcgttgggattcaccacgtccgtgtaccggaaacaattgtactcgagatcgagtgccagagtgtgcaatttatcggccacgtccttgtagcactgttgctttagcaagttttcaatatagtccaagtactggatgcgctgtgcgaatgcgactcctttgcgtgacagtttgcggctagactcgcgcaaaacctccatcactgcccgctgtgcatagcgtttgttttcaatcttttccaagaggaacgacaacagtttggattgattcagttccatcaagaggctgaggtagagctttttgataatgttgtcattctgtatagtctcattgtacttggacttggcctccgagtacatggccagattgatgggtttcagtgtagacacggatccggacacactatagttaccggccaactcctcgtcatcgtcatcgtcttcgatgctagagtttagttttaaacgtttgttagagtcggttgtaaggtaacgagtcccaccggtgctgtatacactttcagcatctccattgctagcaacgatgctggcactggcactggtactggtactagcactagcactaatgtgatcatttacaacagaattgcaatcgtcattatcattagagtactctttggtggaatctttagaggcatctttaggttctttgaactctttaggtatgttaaactctttgggtacgttggaaatatcctcatccgaatccccatcaaccctatcctccctatcctcatccatacacccatctcgagactcggaatcttcaatgttaccgttactggcacttatgcaactattggcatttccaactccattgtccaacagtttctttacatgattgcacactctagaataggcatcgtaatcgttgatgcaactcgcatccgaattgtatccatcttcgtcgtcctcatcatcgtcctcatcgtcactgtcttgcttgtgattttgtatatacgcaggctgagcttgtataatctgatcagcttcagtctgaccctgaatctcagcctgagcctgttgctgttgttgctgctcagccttactcttgtccttgtcagtgtacgatttgcgcagttgctcggcaaacttttcgtacaccaaagagatgaaatgcttcatgtacttgtccaggttcataatcatgtcggtatcgtactcggaattggctccatagtagtgagtgcgtttggatgcaatcaccaccttgggatgagtaccgtacgtggtctgatagatgagaaagtaaataatattccgagccataatctgatactgattgttgcgctgcgtaatcttggactctttttctacctcgggagtgactcgtttacgtcgcagtttgagtgtaatgatgcgagccgttctagtcagtttttgaatcatactggcaaaaatcttactctcaataaactgttcaaattcctgaaacaatatttataggttaaatcgttacatcaaaagtgagattaaaacagtgttgaaaaatggacattttcctatgcatcgaaactagcaggattccaagtgaccctgaaatttacaacaaacccatatgcatggaatcgtcgattctctatgaaaagccagtaatcgatgtccaatacaaaaatgtacaatacttgataccaaacacgatcacgaagcagtttagctactttaaatatgcaatgacgatcaacgcctacaagcatcacatggtcgcgtacatgtttcgtatcaagtacgaggacgcgtgcaaactcgtaataaaacttacttgggagaatttgtttatgttgaacgaggccatctcgtcacccagagatatcgcactcttggtcgacgatttgaaaaaacccccaaactggacgtttatgacgtggctaatgtcgagtcggccaaactttgaaattgcctacataaattcaaaagacttgacagacgtgcgactgtatcaaccttatgttgtggaatgccacacaaggcgtatagcgtattataattatggcgacattacattgctcagataacggttgtttacagtagggtttgttagttttaatcgcaatgggtgataaaaaacaatggcttaccgtggagcctcccatgtttctatacatgatggccttcatgacgaccacggtcatcgagcaggcgttttacgtgtaccaagcgtgcaccgtcaaccatggctactcgccagaggtgtgccacaacattagccagtacgatgacatcaacaaccgagtccagcagactgtgtctacatttcatcagtggaacggtgtagccagtcatgtggtgccctttatattggcctttttcctaggatcctatagtgataggcgcggtagaaagattgtactcgtatgtggactcgtaggtaaactctttttctcggcaatgctaaccgtaaacagtctcaagagctggcccgtagagtatataatctacacggcatcctttccgagtgcactcaccggagccgatttgaccatattcgcagcgtgctttgcctacattgccgatgtgtcgactgtggagaatcgcacgctacgagtgggcatcttggatgccgtctacctgagcacgatgccaaccggtgtggcgatcggtagtgtgctgtggaagcgattccgatcctaccccatcatgtttgcaatcaatacgagtctaatgattgcggccacattgtacacgatcctattcctaaaatggcaaactcgaccagagcaaaaatccctcaaagagactggcctcaagaatgcactcggagactttttcgatttggaaaacatcaacactaccctgaatattctagtgaaaaagaggcccaacaatcggcgactctttttgtggttcattttgctgtcgatggccttttatacgtttcatcgagacgagcgctctgtaatgtacatgtatgcaatcaaagagtttaaatgggacacgactgcttatagccactttagaacctacctgagtgcaatgtacgttacggcgatgctctttggtataccaatcatgagccgaatctttaaatggaccgacacgctgattgtaatgctgggcgccgtggctcacatctgtggacacttggtgtacgctcacgcaaagattgccaacctatggtacctgggagcgacgctggccgcactgggaccttgtgtggctccgctcttgcgatcgatggcctcaaaggtgctgcctgcttcggagcgaggcgtagcctatgcctttctgtcggtgatggagaatgccgttggaatgtttgctgcggtggcgtactctcagctctacaaaaacactctggacacacagttttcaaatgccacattctacctgaccgttggcactctggtggcagtgtttgcactcatgctgaccatgagccgaatgctaaagggtaaacagttgaaggatgccgacagtgatgactatggaaactctaatgatgaaatggggcatgtattatacaatggaggtggttcggtacaattactgttcaacggaaaggttgccgagtaccgagatttgccaatcacaaatgatttgtgtaacccagagtttaggtatttgaaaaatgtaaaagagtttgcgtattaatgtgtagttttgtatgtggtaggataatgtaggtggtaggataggatagtgtagtaaatacatttatatgtacatttaattatatcaaataaaaaatgatgtattttttagtttcatcatttgactctagttttacattcttataaaaacttcaagttgtagtacctacattacaaaataaaactctttattttttagacaccaacatacacggcttggaatgagctcgtgtacgggatccctaagtacacaataaatctaaaaatgaagtttgtcacatttacgaccatcgatgagtatggatcgtttgacaacaagaaggccaacgagctcgttagagttttaaacaataatgccaattgtgtcggtgggttcatcgattactcatcgatgtatccattgatttttgtatttgcatcgtgcacagaaaccatgttttgctacaatctaaacaatgagcgcgatccctttgtcgatcaattggaggctctggtcaaagagtccaagattgtggtcgacgcacagcaagtgtgcaatcttttactagagggttttgtcaatttttcgtttgacgctcgtctaagagtgtgcgacattgtgcgtgtgctagagctgttgaattgtatgattacacgaaaaatgaaaaacaacatattatacggtgtaagcggcgaagctcgtaaatgttattagcgttgtatttgggtgaattatgataggtgcacggttgaccaaagtatacacatacacacaccatgaacaacgcaatcaacaatatccgagctcgcatcacaccggaatgtggccgactggccagtacggtttttgcactgggtatcatacaatcggtggtactggttgccatctcgatcctcttcctggcagtttacttgtactacaacgctgacgttaaggcttcgagcacgtcaagcacagccgatgaattggaaaagaaaaagaagaagattaagaccatgatgattgtatcgatcgtgctggaagtggtcacggtactggcctcattgtggacggtgctgactgctggcaagattaaggactgtgtttcgttggtttcatccacataaattgaagctgcctacatccaccgagtgctctctatgtgatgcgtaagagtgtatggtatacatcaagtgttgtgttgaaatgcaagttgtacatcaaatgtttaatatttaatacatcaagaggtaatgtgtagtatgatcagttgaggtgtttagattaagttgaggtcgtgttagggtagtttgttttagtttggtatagtataatttagtatagtttaggatagtttaggatagtatcgtttaggatagtctagtttggtaatttggattagcagtacatgttagattaagtcaagttctttagtaggataggttgctggaaataatggaatcattaagtacaagatttgtgtaataaagatagatgaactgataaatgacaacattaatgaaattgaataaattgaaataaactgaaataactgaactaaactggaaactaaataaatggattctctctacatctttggtttaattaattcttattttttaaactatagattaaactagatttaaaacaaaataacaaaatatcaaaataacaaatataaaatcaaacccaaaggcaatactcaaacccaaacccaacctcaaccacaatgctgcccgtctttgtaggaacactctttgtggtaggtttgttgtattttttgacattgcgtctagacaactctaaatactatgcctatgtcaacaagtacaatctacaagccaaaaatgaaaagctagccaaattgataaactctgagggactcgagaatctaccgtcactgctcatcgaccacaactcgtcctatgttcggcaacacgaagacttgtccaaggtgtcgcagtgtgccgcagagcctctgtttgtagcaccgctcgatccaaaggacaagactacgctgttgcagtacaatagctattgcacatcgagatgcggttccttgggccgaatggtggtcgtgagtcccagccaagagttttaccacatcaacaagcgtctggcacccggcaagtattgcatggtcgacaaccaggtaaagtgcaatcctcgcaccggctacgtggtggccgacggtctgggctcttgggtgtgccgatcaaagtatcccaacctgtttggcggtacggatgcgtccaaagtgattgcatgcaacaacgaactgcatccgtccaccggcagcatactgtgggacaatttgctaaatgcaccagtaaatgcggccaccgtgacactggacgacgagaacgaattggtgcccggcaccggaacgtataggttcacgtgcaagtttaacaataccaccaacaaccgagtgctgccgcatcccgcaaaccgattccatcccatcaacgatccgtgcactcgagaggtgcccaatgcgcacagcgatgctcgggtcgtgtttgaccacgacgatcgaggcgttgccgtggactggcattgcgattgcggtgatcccaaagtgaccaggctctacaattcggacgccaccgacaacaagtctacgtgtacgccttgcgtgaatcgaaccacacagacggatcgcaaactggacatttctgtgcatttcaagtgtttcaatctaacgtcaatggtgacggatctcttcaaaacggtaccgtgcaagtggtcagactttctgagcaacggcaccagttgcaactatctagaattggagctgtacgagactcgcaactttatgacaccctttgacatcaagtataccaaggttgatggtgtattattaaactaaccgagttttacctttgtccaaattttacacatgagctattgatagtaacgttgaggcggcatgttattagaagtcatgtcaagatgaatcaaataaaactggccaatgctaacctgtacaaaaaggccgcgctcatgtcatggttggagcgcgaccgaatagcgtgcgactatgttaaacgctacggtaccgagattgatgtggacgcgctcaagggactctttgattttgcctctcagctcaagctggaaagcatactggtgtcggtgggcaagtccgtagtccgatccggttccattggcgtgatcaactttttgaccaagattggtatcggcatcgatgccgtcttggatcccaccaagattgatcctcacttggacgatgacgatatgatttctctgattgagcatcgcatcgaaaagttgtccactcgtgaaaccaaaaaacattccatctactataatgtgaccatgaaaatgtttggtcagatgctcaatctgaatctggaaaagattaatcagtctatattcaagaatgttgacgaatcggtactggacaagctcagtgaggtcgcattcgatacgaccaatgaaaacattaatctggatcaactcaaacctaaaactgatcaagaactgaggctgatggaggaacctacagtggttgaactcgacaatgacaacactgggtcccatccttcgtatgacgtttccacaaacgaggtagagtaccacgagtctgagtttgaaccgttgcccgatagatttggacggtatcgtaggagtgtagtagaggacagtgtagaagagggtttcaatggtggtttggaggatggcttaaaagagggttttgaggatagttttattaggacagagaatggtaatcttaggacagaaaatgatggttttcttaggacagagaatgatgttcttaggacagatgatggtttaggtagtgcaacagaatcgagtgtaaaggatgatagtttagagggattggatacatcaaaatcaatagatttgttaaactcattagattcatcaaaaccaacagattcatcaactacactagattcagcaaagtcattaaattcaccagagaatcaattagagccaccgactgcactagaattggaatcatcaccaaaatcattacccgttgaagagctacaagaatcggtaaatgaggtggcatctccagtggatgcatctctacaatccaatgctatgcaatctaatgctatggacgtagactttgaggatgatgcaagtgttacacctctatccaccgagtctatgaatcctaaacatgtagagtatgcatcaatctctccagagccagatacggacaccgataccgatggctcaaacgatttggccaaattggacattttaaacaccatcgaagagtacaagaccaagcagacttcaagaaagcgcaaagcgaccactgctcccagtaagaacgagtggttgttcaaaacgttgaacgaagacgattcccgaccagattcaacgtttaatctctttgatgagcccaacggtgaactgagcggtctggcacaagagccaccgccagacaagctagactctgcaatcatgggctcgacaaaggccaccgcaatcatggatgccgactctcagtcaatggacgagccaccggccactatgaaccggctaccaaagagcatcctgaaacggacccttgaaatgggcagtgaacacgttaccaaaaagagcaagccaacgcgcagtgtacagtttgccaagaccaacacagagtttgatgtactgaacaacattaagccctttatcaaagacaagcagggaaagaatcaacagcagcaattgaatctgtctgcgttggggttgtctacagttttgtagggaggtgatgatagacttgtctagatttgtagagttgtatagaattgtttagagttgtttagaattgtttagaatacctagtttataattacataggagtttataggtttctataggatagtattagtaagcaaaagaatagtattagtaagtaaaagaatagtattagtaaataaaagagttcacaagtattgtaaaaaatatacatatattgtaccatgatgcatttttttaaactctaaattacattaaatatgtatatatatattataacataatattattttttaataaaaaattaaaactagtgtatacaaatatctcccaatccttctacctaaatcctctacacaaactctctaaactccttctcaaacaccacatttccagaatcgtaaaagtgcgatgtagtctccatcctacggtgccgattgaatctggccaccagacccaacggtagattggcaatcattcgggtcgtattgaacactcgtatcgactgtatgccaaagagttcatccggtgaggcaccccgctccaacagtgcggatcgtagcattttattcaatgtggatcgactgacggtcactattcggtccgagtcctcgttggtgtggctcgttaaaaagtctaggaatttcaatagaatgtcacgtatgtacaagactcgtatgaagcgagagcgcttcttgattttaatgtttaccttgcggccttcgacaatgtccatcagcgatttcctagtcaactgttgcagttcattcatacgcaaatttgtacagatgcacagtatgatggacggggatagttcggggtacagccacggttcactggtcacgtccagcaccagacgctcgatggcattgtgtgtgacaatgtccatctttttgtagagagccgtacgctttggtcgcacccatcccaccttgggaatgatcatggagagtatcttgcgatacttgtcccgatccaagaacttgacgattctggcgatctgtacgattgtagtgtttcgatacttgtccttttgagagactagcaactcggccaactgttcggctgtgagttgagccagatcaagctcagtgcccggatgcagagactcgtttgcacgttgtaaaaagttgaacgcgtaacgtatggctctaatgtgactgtcgctgaatttgacaaattgcaagcgatcctgattctgttcatattgtgtaggtttgtaatgtgtaggtgtagttgtatttttataatgtgtagggttgtactgtgcaagtttatgtgtaggtgcagttgtaggtttataggatggaggtgcagagtcgacctctaccttgaactctttctttgaagtcatgttaagagtctaaaaaaagatgtactagtattaaataaaaatgagtacatgtaaaataaagagtacatgtaaaataaaaagtacatgtaaaataaaatgagtatatggaatgtataaatgtaaaatggataaaggtataaatttataaatgtataaaggtataaatgtactctaatcacaacaataataatacaccaccaccatgatttgtaaaatgtaaaagaatgtaaaagcatgcaaaaactctatctactactaccactactactactaataataatccaaatttatcatcatgcacacaaccaaggttcacaacaaatgatgtaatacacaaccttagtaatacacaaccttacctgccatgtctttatattttttaaccacaatcccaaattgcacaaaacccaagtatctaggaataatactctaggaataacatgtaaaccccacacctaaataatactctaggaataacattacaattattcaaacaagtaatgtaaccattcaaacacaatggaagactgtaacgtaaatcttaaactaacattatattcttaaaaggaatgtataaaatatcattataaaatatcataaattctcaagtcttaaagttccttataaaataaatccttgtaaggaaatccttactagctgcaccggttgccttaaatctaaatttgttcgtcagttgcatataatcacattttgattcagtagcactttgagtatacttttttgtagtacaattgtacaacttgtagtatactcaatgtatgcatgcacgtatgcatgtactagaatatcatctagtcatactactcggtatcaatctcttcgtctttaccgattgaatcaccctcaccgttactgccgcctctaccagcaccatttctcttcattccatcgatcctagcaactgcacttggtctgccgcttccacgtcctctgcctgcactgagtctctctgaattgtcgtcaatcgaaccccgtctgcggtacatgggctccagtaccatgggtttgtccggatcgatcgcttcgtcagtgtcctcctcgttggcctctatcagtcgcatgcccctggtgacttttctgccgtcttcgcgttcgtacgaatcagacttgtacacccttgatatggtcataaacgagcatacatcgtttgtgtctccgatcacgtctagacggtgctcgtccaccgaactgatttcgtgtatgggcttgatgactagcacgtcttcgcaattgggacgtatcgaaatgattcgaacgttgatgatgcgcgaaaacgcaaaggtcgacgaatcgctgtccactacgtccacgagcaccgtcaacggatcaaactgatcggacgagtttacgctcaagtctttgcaatctataaaggagcacttgttgacctgaaagaccaccttggcgggaatcttttgattgtacaccaaaatgttgttaatgtgcaagttgtcgcactcttgcagatagattgcacactcggcatcgtgcattgtacagttttgaatcttgctaaactcgcagccttgcatgaagatgcactctcgggacgacaccacaaaggtgacgttcgatatggtcaagtacttgcagtcgaacacatcaaagccgttgcccacaaagaagagattctcaaacattaccagtttgcagtctcgcaccgtgaccagaccatcctccataatgtggctgttttcataggtgcaattgttcgagttttcataggttacattgcacgcgtctatggagcgcagtaggaccttttgtgattccaccaccttgagattctttatggtagagtgttccaagcgggcattctgaacgttgctcagtgcgaaccagtctacggtaatgttgttcagctgcacattggacatgaaactgatggtcaactcgtccaaggctacattttcaaagcgacacgtgtcacaattcaccatcgtgactcgatccatagtcaccgactctatgttcatgtttttacagtctcggaacgtgagcattccgggtccggtcaccttgctggcattggccgacaaacccttgatggtaaagggacgaccctcttcgtcgctattgatagccacagcttttgacattagaaaagagccggcttcgactaggcccacgtctccagtcttgagcaagtgtgtgataaaggcctcgatggcttcggtgtcgtccgtcacaccatcacccacagccttaaagtctcgctttagccacttttcgtgattgatctgaatagactttatcgccgtgttgatggtggatatgcgcgtattgaaacccatctcggtgtctagctttgctgccaaatccctaatattgttcaggttgcctagaaagtctagccggttgagtttctcctgaacctcgtctcgagagcgtacaacctctgccagtttgccctcgtactcgtcgcgttggtggtccagcgcatcggacagggacttgatgcgcttcgccaccgcaccgtcgtccattatgctgctgtcggtcaactgtttcttgtgctcttcgaatagcgcgcgtatggatcgagtctgtacgttgacctgttccagattggtgtcaatgtactcgtgcagtcggatcgtcaactgatcacccaaaatgctcggatccgtagactctttgagtttattaaacgacttttgcagattgttattctgctcgagtacattggccaaaacctgacaagcgtccacaagctttacgtgcaccgtttgcaactcttgtttcagcttgggtagttcggtcttgatcttttcattgacatctaccgtgaccgtggattgtagttcgtccagtttgacttgtagtttggacatgcgattgttaatgtcaatgtcggcgtgttgcaatatggaaacgtctcgatgcatctgtttgaggtgttcatcgttgtcatcgttggtggtcgactctctgtgttcttggaccagcttttgcagctcggcaaggatgctatcgcgctttgccaactctcggtgcacttcctcggcgttggcgtacgatgccaactctgacgattccacatagttggccagcctcgagccaaaatagttttccatgtcctcgtctttgtcggtcgcactgtgcatccttgcctgagtctgcacctcttgttcaatcttttgcaattgtgcacccaggtctagacacttgtcatcggaattcgagtaccatttactgtggtagtagagtaccatgagcccgttgactagtatcgccacgaccacggcgacaaatataaatgtgaaattcatgagctgtttcgatattacacacgcctcgctattgcatcgaaatgatttccctcaagcatatatacgcagttacaactaaacaccaataccgtattaagagtgtgtaccggtcaaacattacagactgtaattttttaaaaatgtttgccaatcgtcagtatagcgttgattctcacgagtcgatagactctttggtcaagtcaaagattgtctcctgcctgaccagggacatgctaaacgagatgttgctcgagcccgatcggttcggtgaagagtcctatttcaagtttctactggccatgtactgtaatctgtgcgaactcacaaccattgcatactatcccatagagtggcacgatcacgaacccatcatgcactacactagaaaggatcgcaccgtggtgcatctcttttccaagcctgtaatcattgatctcttcaagggcatcatcggttcgaatacgtgcaagtctaccgagttggccaacaccaatgtgcgcattaaacagattcatgtgattccaaacaatggaatcgccttggccgatgggatgccaactctaccgtcgcacattgccgataagctaatcttgctcacagtgattgccgatcacggcgcctggcactattacaacctgaagcgttcgcgcaacgccaaagagtaccgactcactgcgcatcaactcaatcggcacattagtctggcctcgttgatcacgtccagtcccgattcccaggtgcagaaacagacgaccgagtgtatgcatccgtgtttgataatcaagacttcaaacgtggactctgatgcaccggtcgtaaactgcaacaatggcaattcggaagacgatggagactatgaagatgatgacgatgaagatgagtgcaacgaaccgtttagcaccactcgcagaggcggtggttacattaaagataaaggctcctataaagatgccaacgactcgtcggcagttttgaattcaatcgttaccaaggattactatgataattagactgttgcgtgtatagagttgtaaactgaaccattattagcatgcaagcgcaaagtcataatcagcttgtaaacagaccataatcgtaaaccatccaccgtgaaagtattggcactttgtacacgtgcgagttgcgagcactaaaagtgtaggagttggtgcgttgccattaatgtaagggtaggcgtttgacttgaagactacttttgtagtgtatggtactagtgtccattaatcgagatttaaacaaaacaggtattgggatatcaattgaaagaggttggtatagttttataaacatttattatgtaaataaaattatcatgtaaaggtatttgtaaaattatggtattcaaaaaaatcacaatcgttgttggttagttgcttggtttgcttggttagcttagtttacttggtttgtaaaataaagttgattaaataactaaacattgttggcattgttattgttaaagtaagtaggtagattgcaagagctacaattgttgtagaaagttaaaattaagtaagtgcctacacgaaaagttttagcaatacacttgcaggatagttgccatcattgaatagaattgttgaaatacagtacagtctaaagatggagatatgtttaggtaggtttgtattttttaaccattaaaaatattatgctaattgagattctaaaaaactaaaacatactaatacaatctatgttaatacaatctatgcatacaatactaatataaaatcgttacactactacaaatttgttactagttttgctattagttaattagttagatactagagcttttggcaccacatttggcatcacaacaatgagttggtaagagttggtaaaaactaattacaaccatcggtatacatttataacaacatttctgtataaaatataaaagagttcatctataaagtttgttaagagttaccccagtttccatcaccgcgctaaattttaaacgtctacaaactctactttctccatgaagatccaccgctgctgggcttgtggtgccaaaagttcatcttgtggtgatacttgttctcggtgtagtcgcgcgtataagtctgcgtctctacactcctggttgcgggcttctgaacagtgtgctgaacttgttgcacagacggtgtggcactgtagccatttgtcgcactgctatagctcttgaacgcagtgccactgctaccgttactcgatccgtttcctccattgctattggtcagagtgatgcccgacttgtagaacgcacccgatccggaaccagagcttccaccgtagccagaagagccactgctactgccagtgttgtaagagttgtagctacccttgtagccagaattgccgtacttgttgtccttgtacatgtttgcagtaggtattctcaaatgtaataaacagcaagtgacactacacttcacaacaaggatgcaatatccactggctgaatcaccgatactgaattatatataaatatccactatggaattagtttgaatttcccgagtaggtagtagtgtttttatataaatgcaaatacacactctcggtatgggattcagaatattttaaaataactttaaaatatctggtataaatgctaaaggcaggtagtttttgtatacacgaccaaattttggcagatgtttacaaaatgaaggttcacaaccgaatgaccaaacctcgaacagaaccctccttaaatacccatcctatgaaaaaagtttcaaccaacaagcacgcacactatacaataaacgtatttttgataacacatttacgttattggcgataagtatgtgacattttatgtagaattgtactctgtttgaacaatgagttcgataatgaaaatgaactcgatccttcaattgttcgatgttcggtcgcctgtcgcgtttcatccttccaaactgaatccgattgtggactcgttgaatccagactatgaaaatgagcaggatcgcttgtacaaagcttaccagcctagtgttgtcgatgttgctcaattggacgatttcaaccgagtctacttggactcgttgaaaaagagtgcggtaaccactaaatctatatgcatcgacggcatgagcgcagtaggcaaatcctccattgccacccggctcgacggcaagatgctcaagccgggcagtggctctagattgatttcgcgcaactcgcatcccagctcgtgtatggcgtacgtgttcaattttatcaaagcaatgatcgaggcggacaagggtggctcggtgactctgtttgatcgtttgcctttcaacacgctcatgtggaacaagatttggctcatgctgggacgagccgaacgggagggtacgattgatgagaaacacatgtttaaatacaccgactacctggactcggacgttatcgaatccatggccatgttgtcgttcaacattatattggtggactcggatttcaaacgagccgcacaacgattgcgagcccgtgaagaaggctgcgatgtggaacgatcccagtggtggcactatatgccgattcaatactttgcatatgtggctctgcacgccagatggccgcatctcttttacctgatcgatttagagtccttcaagggtgaccagagtgcgatgcaagactatgtggtctcgctcataaaacgcatcgactgttttgcatccgagggccatgattcaatttacaagtttgaaccgatcgacatgtgcacgtacaccgatgccgagaccggtcaacgagtgccgtacgtgttgtgcggtgatgttaaacaggaaagattacgtccgctcatggacgtgagctttaccgatggcgtgaaacgattcacgctacgacaagatgactcggcacactttgtacgattccatctggttgagccgaacggagtcttgttcgaagtggtggacaagaatcgatgcaagcgctacaaactcaaacgcatcaacaatgggaaactctttgcatcggccaaggtgtgcgatcccataggtttgtggaatcaattggtagagttgagcgatggagtgttgatcaagaacagagtgctccgattcaaaaacaatcgtagtcgattcgagtttgttaaaatgttacagaaacgagtgtaatacaatgtaatataatataatgcaatataatgtaatgtactagcatgtaaagattaccaataaaaatctatccataaattctctcttgttttttagaatccaactagtctacttttttgcatccaagcatcccatcctaaacaaccggatcccttggactctaacctctggctctgagaattaatcaaatagatttacagactaattagccataggtagaggacttttgcatttccagaatccattagactcgttaggtttagagagagaattcattacatttgaccatttgcttgattagttcaattagtaaatttaccattagtaggcaataaacaagtaattgaagcaattgccagtattggtaatttgaatgcattagcatgtaaacatgtagtacactttgtaatccatgattcatgttttttagtatggtacaatgttaaactctcattgtattagaaacgccgtctagacttggtgtcaatcaaaaggcctacctacataaacacttcctgtctatacatattgtagctagatccgagggctttctaatgtcaatatctaacggtgaattctccatttcaatttaatacctacttctagttgaatgtaaacatcttttagaaactcggctttttccaataaaaaacaccttggctttatacaggctgtaagttgtaagctgttttttagattgaataaattacactgaattgtatatttacacttgttctttatgattttacgtagtcttgtaattttatacctttacaagtgcacctttataagaaggcttatagttttacgagtgcactgtacacttggttaattggctttgtttgcatttattatacgctcagcttttacacttggactcaggctcttgcacttgagttgtgattttgtttacatgctagagatttagtttgttgttgtagtagttgtagtagtagtggtagtgtgtattgaatgtaattcagtttacactttgtacaaggttactgggttagaagattgagggtagaaagagtggccgtgttggtaggtttgtattggttgtttgtgatggagagttgtttgtgatggggagttgtttggagattggtagttttaagatgggttatagaggcttgtttagagttggattcaacagaaacgagtacacttcttttaaactagaatagactttattcagcataaactacaacctattcaaaaaatatcaaacatcaagtaacattaacatcaagtaatatttatatcctttatagcagacctatgtataaagcacatcagtctttgactctacaatattcaaaatgtacatttattaaaaaatatcataaacacatttattcttgttataaatacatttagtattacttactatgacaatatttaccattacatacatttagtagtactatggatacatttagtgtaactcttagtttacagccatttacttgaacattaaacttgaacatcaagtttaaattatctcacaactttatagtattacaactagtattagataccaacattaaactatattgtacactatattaaacatttatattgttttgtgtttacatctatattaatacaccatattaaacatttatattgtacatattgtacacgtgcactctacacctatattgtacaattatattacaccaattttaccatgtttcaatttactatgcttcaatttacaatgcttcaatttactacacctcaatatattaccctacaatacactgcaatacactgcaatatacaacactacaaactgctacaaactaccaccaccccacacacatactaaactatccctatattgcaaaatacaaccatcaaatctagtgtttaacaaccactctgaaactaaactgaatccactaatattcactaatatccactaatatctactaatgtctacatagtccaacatttaacgagttcaaaatcagagtatcaccaccacctaatgtttaacacccatctgctccagctttatcttgacaaagtttatgaaatcgtcaacctctggtgtagacttgaacttgatcaaattcttgacaacattggccgtacgattcacatgtctactgtactctttcataatattgttccacacaaacttgaagctcttgtccaaccgagtgtgtacggccatctcaatgttgcccttcatctgattcagcttgttgtacacatagaaacccttacccattatgcagcccagagttttgccacatctacccttgcggtacactacaaggtagcgatcttcgctcttgaatcgtccgggtacagtctgtttggtgggtctgtatcggatgcgtctgttcttccgcagtctggtaaacggtccctgtggctcgtcgtccatctctacattcagtttggaatcggaatctgcttctgttgtaggctcagtgttggcatctactttgaaatctactctactggggatgctgctatggctattgctattgctactgctgctactgctactactactaccaacaacattagaatctacctctacaatattgtcaacacaagcctccttgagaggctctaacgggccctctagagattcctccattctgacaccctccaccaaagagccctccatttcgtccaagtgttcaattatagtgtttagattgacattgccactgcacggttgcataaagtcatcgtcgtcaatcgtaaacgccggcgatagactctttggcgagtccataaacgtagactcggattgaacctctgcgttaatgtactcgaacaagtcttccatgtcttgggccagattcaggcacggctctatgcaatcgtccacgttaatcttgtccaaatcgacatccttgcactcttcggtggcatcgaaaccaaacacttcgagcgcgtccaagtcttcggtttgtgtgcactgatcgacacggacaacggcgtccgtctgagttgtgcactcggacttgttagcggcacccatctcggtcgagccttgattcgcgactcccgagccgtctttgatgtatgccttctccatggcgagtacggcctccatcaatttctttatagtgtaatccctctgtttgattttacgcttgagtagtcgcgccaacccctggtagctaatgaattcattgtgaccgatcgacatgcgatgattcggaccgagtccctttatacgcagagagccaaacgcgtcggccaactctttgctattgaaccaatactggttgcggagtactagaggcatgatgtgtctacaaataaaactagacctcaaatgatgctctcaggtgctactagtggcttttattgcctggtattatctggtattatcactgtgaacaagtactataccgcacagcggtgtgtatcaaactgtacaactttatgaagttgccgatgttttataactaatagggtatgtgtgataaacccaagccgactttaccagttaatggttgttacaatacaaacgcaacatgctgagactattgaactctcaactgggcaagcgaggcgtagtcgacgatgcgctgtcccatagattactggaaaaatatccgactctgagcattcccaacgtagacttgaccaacagcgaacagtacctcgtcgagagaataattaacaatagacacttttacaatttatgtattgatggaatgtcttgctcgggaaagagtaccgttataaatcgtctaactaaagactattccgcctgcgcttacaagatcaacagcgagctcgagtgcaaagactacaatttcaattcgaccactgcgtttcagtatgcgctcaaacaggctctaaactacaaaaagatgaaacgatgcatcattgaccgatcgattctgtccaatttgacatttcagctagtctactggctcatgtcgtgcgaggactctatgtatgaaaagctgtcgccgcactgcctctgcgtaaactatatacgcatgcatcaaatggagccggtactagagtttatcaaggcccaaaaccacaatgtgttgattgtggtcaattccgactttgaaagagtctgccggatgatggtggctcgcggtgccggaggcgacgtctacaaggggctcgttcccaagtacgtagcgtctcaataccatgcatacatatttatggccaacgtgttggagttgcccgtgtttgatcatgcaagagtcgacagtggagtcgattcgtttgaacgattgtacaaaatcacatctaggatgttttcactgctaacgggtgacgatgacgatttcgatgccgagtttaatttgttggaaatgtcgaatgccaacaatggcaatgatgatgatgccaataatggtggtagtagcagtagtactggtactggagatggtaccagcgctagcattggatcattcagtacccccatcgccgacaagccttgcatcaaacgatccaaaccgacagaagaggaatggctcgatcgtctagtgtcgttgcagatgaataagcggtaggtgtagattccaatcaagtgtagtagtaaacaataaaatgtaataataagatgtaataataagatgtagcaataacatgaaattaaataaaatacatgtatgctttttgtaaataaattcaatttttttgtagacatgtatgctattggtgttatcatttgtggtattattgtaggtggaacactatataaataaattgccttgtccatttgcatttagttgcattctggttgccgtagaggtactttaagtagatttaaaatttacaagttgaagtaagaatttcttttagtgcacatacacacaggtacaacgttgcactacaaagtagacagcttagcgttcaagtggaaaataaatttacaactcgtagttgtaaaaattaattaacaactctaaaaaagagatagatacttactacaatgcagacaaactgggaagagcaccaatacttgaacacgatcagaagtatcattgaaactggcaatcgccgcatggatcgcaccaaagtgggtaccctgtctcactttggagtgatgcatcggtactcgttgagggacaacaacctacctctgttgacgaccaagactgtctttgtcaagggcgtcatcgaggagctcttgtggatgatttccggatcgaccaatgccaaagagctgagccgaaagggtgtacacatttggagcggcaacagtagtcgaagcgttttggattcgctcggcttcaccgacagacaagagggcgatctggggccagtgtacggattccagtggaggcactcgggcaccaagtatgtagactgcgagacagactattcgggtcagggtgttgatcaattgcagacaatcattgacactctcaagaccaatccaacagataggaggatcgtaatgtgctcatggaatcctgcagatttgcaccaaatggcactaccaccgtgtcactgtttggctcagttttactcgtacgatggcaaattgtcatgcttaatgtatcagaggagtgccgacatgggcctcggtgtaccctttaacattgcaagctattctatgttgacgcacatgattgctcacattaccggcctgaaagcgcacgagttcgtacacaccattggcgacgctcacgtgtatttaaatcacatcgagccattaaaggtgcaactcgaacgggagccgagaccttttcccaagctggagtttgctcgtaaagttgaaaatattgacagttttaagtacgaagattttataataaaaggttacgatccataccctaagattcccatggttctggctgtttagagagatatatatgatagatgtgttgttataggtgtccatctctagttgaacatgtagttggttgcagtgtttatacgagtaccaatgtaatctagttgtataattgaatctaatgtgttactctaatgtaatcctctaatgtattctttatatcacactctaataaatgttgttttttagtcaaacagagtctatacttttttcatcacctttatccatcaagttgtactctaccaaacctacctacactaaatgatattagggtaaccaacaaacccaacacacctacctccactaaatgatattagggtaaccaacaaacctacaccagagacagtctaaataaaagacgagacattgtaaattgtaaccatttattaaagcaaaatatgtaatgcaatataatacaaaataatgtcatacagtaaagttatagagcatataaaagttgaaagtggttgtacaagaatgtaagtgcagtttaaaacatctttaaaaaccatctttaatgttaatcctcttaaatagtaatcatagtaaccatgttaaatattaaaacactatccataatactaaacatcatcttgaacattaaccatcttaaataatcttaaataatcctaaataataaccatcttaaacatcttggatggtaaacatcttgtgtgctaaacattttgtgtgctaaacatcttaaatattaaatattaaacattaaatattaaatattaaacattaaatattaaatattaaacattaaatattaaacaacttaaatattaaactaaacatctttaatacaaagctaaacattctagacagtaaacagtaaacattaaagtagacagttataacactagacaggcttggaaatcttggacacaaaatgttggccatttattatttattatcaactatagattaattctgacttttagtacatacaagctaaacatttaattaaacatttatacattgagattccgtgtgctgatattgatgttgaacattattatagtgcattaaattttattctaaacatttacacgctacatttaaaatgctgtaaaatacaagtggctttaactacactaatgattacctttttaaagtgctccaaagtacttttaaaaattccaaacatttattggcttcatacatacaacctaccattagtgcctattaggtctgcgtttattaccaccactactactactagtggtagactttgttttggagcgaaaacgtttagatggaccaccaccgtacaaacgacccggcacctttttgatcattttagttgtaggaattttcacagttggaatagtatccattacaaagttgcgtctagtaactattggctccagcggtagcggttcaaactttacaagtattccattggccgacttggtggtcagaggattctcagtggtcgtctttttgggaataaccattattacactggactttgtactagtggatgtaggtagcactggagtgggtagagttggtaaagttttatcatttctcgagaggttcagatcgtctatagtttttatggaaccatttattggcttcaaaattacgggttgtaaaagtgtaaaatttaaaatggagctcaaagttggaggatggtttatagagttgtcaaaatgaaaagcatcgtcaaaatgaaaagtatcatttactggactcaatagtgtaacgtttgagtggctccgtgcaacctctggaggaaggattgttttcaatattgtcacatttggtgtgcgacgtggagctggctctataatttgaaggggtatttttgtagtagatttagactcggtcttggatacatttatagattcaagagtggtacctttggtgattgcatttgggatggtaacatgtttgtgattagcaacagatttgggtgtgactctagtgaccgattcaggctctgtagcagcctttgattcagttgtaaaatctgttacagtgcttgtttgaacagtgccaacacttgttgattgtacgagcacttttagtgtggagagtgcctttagtgtgccgtttgaaattgcttttagggtgctacttccgagtgtagtaaactgtttaaaaggtgttgtagttagatgtgttgtagttagaggtgttgtagttagaggtgtgggtgttgttttggttgttgttttggttgtttttgtagttgcatgatgattatgtaaagtagtggtagtaggaggtagagtagtatgtaaagtagtatgcagcgtagtatgtagagtagtaggcaaagtagtatgtagagtaggatgtaaagtactaaatttagagctgcaagtaggtttacaaacgacggataaatcctcaagcagagtggataatggaattggctttaaagttgtagtactaggtttaaaggttgtgagatttattgtggtcggtggttgtgtgagaggcggtgtaagaggttgtgtaagtagccgtgttgtagttgcaagtgtatgtttggttgttgtaggaggtttagttgtgagatgcttagttgtggtaggtttggttgtaggcatggtgctagcactggttgtatgtttaattgttgtatgtttaggcgttgtatgtttaattgttgtatgtttaggcgttgtatgtttaactgttgtatgtttatttagcagcgtcaataatggacccagagttggtaatatctctagcaatggcttcaaaggcttcagtgtaggcaaggtaggcaatggttttatagtaggtcttatagtaggcaatggttttatggtagggaatggcttaagagtaggcaacggcttcagtgttggtagggtatgtttaccgagagtaggcttgggtttcagtgtcgtagtaggtttgggagggttagttgtatgtttgggagggttaattgtaggcttagttgtaggtctgattgtaggtttagttgcatgcttggttgtagccttatgaagagatgttttaagagtagatctaatggtaggtttaagcgtagacttgatcgtaggcttgagtgtatacttgagagttgtcctaatagtgggtttgactgtagttttaagagtatatttgattgtagttttaagagtaggtttcagagtatgtttcagagtaggtttaagagtaggtatagtcggcctgggttttacagtagttttagccctcttcaaggtggtgtaaaatttaggctttactgtagtctgaatcctattctttaataatgtagtcgtcttttgtttcagtatggatgcagtggtgctagtaattttactacctatagatttggtagtattagtagtagcagtatgaatacgcttgccaaagtttgaatttaatccatccagtttggaatcattaatcgttttattgtccgtatttttagtgtttgtaccaacttggacagttatactggtagatttagcatgtgccttaccagtggatgtattagtctgtttaatgtcagttttagtattgggtagattgccattgacttttggaatagtgtcaactttggatttaaagtttataattggtctagtgtagattggtctagcgttgccagaaagtggtaaggtattgagtctcttaaagtttgaagttgcaacagtcctagtattatttagagcaactctgcgttgaccgtcaaaactatacgtttcctgatctctaacgttcaactgaaacttttcactacgcctactgaaatcgttttgttgcaccaaacgtttggcatctgctctgcctctattgctcctagtatttctagtgttgatgttgctcgtattgttgatgttgttcctagtagtactactaatattggtagcactatttacattaacctccccatcaacatcctctttcaaactacgcctgtatcgtctaaagattgcatgttcactgggttgtttgacgctgctagagtttgcaatcaaactactcatactgtttaaacctcccatgccatttagatttccacctaaactcgaatgcatactcttttgaatatcatccatgatcaagtttagtgttacttttgtataggtctgcaacaatctactaagacgtcggtgtagctttttaaagttggcctcgctgaaactggaaccggtatccggctttctagacaatctatcaataaaactaggcatcattctgtccataaaatttctatccataaaattggaaccgtttgcgtacagtagctctagataggatgcattgttatgattggtagcgttgaaagtatggttatgatttagtgtggcgctattgttattattattattaggattatttaaactgaaattaaaactattgttaaaactagtagcagtagagtccaaacctgcaaaagtaccagtttcggatccagtgtgcactacgccaccgttgcgataattgtttgcaataaaactagaatcgacatctttaaacttcaactcgtactcgaacgaatccatcaagagtatccgagtcattagcacgacgattgtaaacagcaccagaatcgcaatgagcgatgccacgattgatttgatgaacagcgacgatacctctctgcgtgcgatccattccttgcgagtagtagtcctctttagccagtcgacagcagacgccgccaccgacgatgtaagctccggcggtggcacccgagtctcctcctcctccgtttcggcaccgacagtgttcatcgcaggcgtcgacattgatattatcggagtgtggcactcggtcgtcgtctgattgcattcggtacacacaacgtctatgcactggacttgattgtcgtcgcacgagccaaaagttttaaacttgtaatacgacggaatgcgtttgctgcccagattgattcggtgcacattactactactagtgctaccagtactgcactcgtcgtcggaatttaaagttttggcaccagagtccatcctctgagagtgtaataaacttgataaaaaaacttggaaaaacttgagaaaaaacttgtactaataacaacaaaagcaactgctacggtatagtaattaattcaagagagagggtaaaaggaaaccccttcagtctcggcgtaaggctctctgtgaactgattcccacaggcgaccgctggcacttttaaagcgcggcaatgttaggtattttttagtcacacaggatgcactactaatactaacaataacaagtccaggatgtgatcagttgcagattacaaagagcacacgcgcgccgaacggttgctactagtgtattgaaggcgcgcgcgtgtctaaaacttggtaatcaaacaagtggccaacttgatcaaagcagcactatgaccggtacattagtaacggtccggtactattgttgcggggcgcgaccgtcagcacccttggtcgtgaacaaactgaaattcagaacactgttgtacatcactgtgtaagaattttattaaaagtcttgcatttatttaatcaactctgtttatgcaatgcagctacaatagcgtattgaaagtgtctaaaagtgcacattattgatgaatacacgatggcggtcgcattgtctagaaaacgaaagcgacaccaactcaaggatttaaacacatatttggaagtgaacgagccacgagtcgaaccgcagtcgtgcacgtacttttatgtaggcttcaacaagtaccaaattgtaacgtcaaacaatcccgtcgactatctgattgaatacatcaattcgtgtctgaccgatgtcataggctacattcgagaagagggctttgatctatgcaacaaggcaacgcattctcatatattgacacatttagtgtgcggtatactttcgtacaataaaattctaatgagcaacttttaccgatgcatcgtacacggtccgcttttgatggccgaagcggcaattctagtttatcgcatggataacagcgctgcgctatacgtgtccgatactatgctgcaagactatttggcatcggagagtaacacgactctattattcgattccaagtttgatcagagcgacatctcttcgaccacggtcgatgatattctgaaaaagattccactaaaagtaagcaaaccgagcaagatttacaatcagcaagaggacgcactgtacgacaactctgcgtgcgaggaacgcatacagcgcctgtttggtggaaaggtcgacgacgcaccaatcgcagagagcaagtttatcggcaccctgggcagctacacgggtacgtgccaaatggacgatatcgagtttaaggatcgtctcaccaaaaagaagcaaacctctatactgcacaaactgtttatattggccgatcatgcagttacccactttttggaaaatggaccgaatcactctgaggtgcgaagctttatcacgcactcgggattcggcaccaagaatgtgcaaacactgcactcttcgttgaaaattataggcaccgtttcgggtgttaatggtccgggattaatgggatccaccggaggattgtacggaaacggtctgctggccaacgatcacgttaccttgaattatgatgatggtaaattgttgttgtattaaagcaattgtataatttgaagaggaggcggagtagtctataattgcactagtaatttttagtaatttcagtaattggcgtttgatgaattatgcatgtggatacattgtagctacctaacggtgcacctagtctgatgtagtataatactcagtctgtagccgtgtatttgtatagaataaatatcaaggtatcaagtatcaagtatcaagcatcaagttttagattcattcagttggatttatactgttcaactttttgtattttttaaacctattgtatatgtattatatagttgtttcttcaattaataaaactaaataacaaaaataaaatacaataccccaaaccacccactttagtttaactctacaaacaattccataatccatataatttcatttgtgctccagttggcactctgtgtgatgaccggtactgtataatactgcagcgttaaactactcctaccactactattggttgttgcggatactactactactactactactacctactattattaaaactacaaaacacaaaaacagaaacacaaaaaacaaacacaaacaaaaaaacagaaaatacaactaaagcctaaaactagtatacctacatcatcatccttctctcgaaaactttaacaattccaagtttatcatttttagttttattaaaacttggaatgtctgcatgagactgtacaaaactatataaaactgtacaaacctgtataaggctatataaaattatagctataaaaaagtccacaccaaatgcaaaattaaatgctaagcaagtacaaaaattctagaaaaatgctagtttataaagtacaagagtcaaggttaacatatataataatatagcacatatgcacacataatatccttggtagtaaaacttttctctcaaaacaaaaggccatgtgtgtatgtgtatgtatgtaggttgattttatttttatttcagtctttaatacgagtacaattagtagcagtagaatgaacacaatttggtattgggtgctaggaaaacaataaatgacaatagatgaaaaggattacaaagattacaaagcttaaagactacaaatcaaacttaaactaaaacgccgactctccagattcatcattggtaaacttgataaatacatttaccaattcatttgttttgggatcgtactcgtgctgttgtttcaggtcacttatgtaatcgacaatcttttcactcatcgtaatcgaacagtgcttgccaatttcgtgctttaatctgcgcacatttatacggccgccctgtctgtactcaatctgaaatatggattttaaatcactccaagtgtcgtcgtcctttttgtacgaagcgctcttgttgctattgttggcgttgtttgtatagtgccctgtgccgcctatgccatagcacgaaccctcttcgtcttcgaaacctataccaatgtagcgcttcaagtgttcattgtaaaactgtttaaactgcatcctaaactcggacatgtacttggatagcgatatagtcttgttgtaggccgagttgtactcaatcagcttgagactgacattggccatgaggtcctcttcgttgatgctgggcaccgaggtggacgacatggccacattggactgagacggtgaaatcactttaatgttgcacatgtccagcaccttgtacagatagttgtttttcaacataaactcgtacaacagtttggtagagactcggttgatacactttggcgaaacgataccatagtcgttgcgatgctgtctaaagtagacgtacagcagattggagaggagtggtgccatcttggacacttccatttgctccttgtacgtatagttttcggcaaaggttagcatacaattgggatccttgaccacatcggtggccttcatctcaaacaggaatataatgattcgatctcggatggcctcatcgggcatggtcatgtacggcaagtgattgcacgctgccaccagaaaggtgcaactgctcaacatgggaaacttggtcgaaaacagggtacggtcatcgttggtgccatcgtcgcccgtcatcgttttgagcagattgttactgatcgagctcagttcattgatgatggaaatgtacttggtcttcaagtgtatggcattgggcgagggaccggatgactttacatccttgtactctttggaggttcgatagattgcatcgtcgttgcacatttcagtgtgcaagttgagcagtgtagttttaccacacctgggactgccgtagtaaatattcatatgtttttgcaccttgcacggctggtatagacagcacgtgtacataaagtagtctctcaaaacgtgctcgttgtacttgaacgtttccgagaggaaaacaaagagctctttgtagtgtttgaattcgggtcgacagtgacgaaacacgtacgaccatacacgatcccataggtttagcttgttcttaaagtgagcatcgtcttcggtgagatttgtgtatatttgcatcaaacgatcaacctcatcctgacggcccatgttgataaagttgaaggtggcatcgtccgaatctacaatggtttgactacaatcggttacgcatttactctgagaattgtttctactagagctgggactggcaccagtgtttggattggaattgaaacttttagatggagagttgcctctactggggggtttattgatattattgttaatatttgtattacttttatttttagattgaaaattgtttatattggcatcattatcattatacccatcctcatccattccctcataatcctcagattctccaaaaccagtcatgtcgagatcgtgcaactctaccagactaacattacccttgatgatgccgatacccttgccagactgttcgaaacctacaacgttaccattggccgcaaacaagactgatcgttccggatgcaatagggaaaagcacaagactcgtgcgttttcgtgaacctgacccagttcggcatcggactgtaccggtatgggatcgtccatgatcgaacccatcagcgtcagtagaatgcaagcattcgccacgatgatgggctcttcggtaatgtcagtgttggtgtcaaacgacaagcgttcgtagcactctttgaccgtgtcatacgagagctcagtgtcgtaggcctccaacagggccgagatcatacgagccaatgccatggtgtgaccctttagtttggccaacagtgggtgcacgaaaaagtagcaacgctcgttgcgcatagagtcaccctccatgaaatgaaagatggtcaaccatgcccgttcggctagatggtgcgagtagatgctatactccatggttagcaaaccgggcagcatccgagtcaggtagaacaagagacgttgattctttagaaaggtatccaacagacgatagtagtcatcgtacgtctttagcaattgaaagttcataatgtttaaatctttggatccgctcagagtgtgggcacagaagcgcttctccatgttaaagtagagaaacggagtcttgggcagataggtgccggtgattgtgtaaaagactccgtgactagtgttgataaagtaggtgtactcgttgaagcgcatctgtcggttctttagattggcaatgatggtggtgcacgcaatgtccttttctcccttggacatggtgtcaccgatgcccagcaacgactgaatcagacgcaccgtattgcactgtttcagctgggtcacttgttcgtaggccttgttggtgtaattgtaaatgtagcagtcttctccgaaatccatctttatgggaaaacaaattagctttatgattacctcaaaggcctccacactgggaccctctacggcgcccagactaaagacatggttcatcacggccgatacgtactcttgcatagtgttcttttgctttatggaaatctccaagattatatagtctagcagatcgttgtaggtcaacgcaaacgatctggagagttcgttcataatcttgtatcggcgcatgctcttgatgatttcaatcagagactcggtgtgaccgtctcgggagaggaacgtgctcaaatagtcgagtacatcattcttgatggtctcgtcgtcctcggaggacatgctgtcgttgcaacagtacatgatggccacgatcaacaggtacaccgagtactcttcgttttcaatcagagcactgattaggtaggccacgttctctgcgttgggatcatcgcactgcgcaaagtacaaactctcggccaggtagcgattgagcgagaccagcgattgctgtatcggtctgaaacgttcgtccaccgtgtccgtatcgagcagagttacgctattctttagacgcaactcgttgcgcatagtcaccacgaaatccaacaactggtacgtggactgtacgcttttgatcgattccagctttagccgacaaatggtgtccaacagggtgggatgttgcctgacttggataatcttgttgttgcccacatcgggcagtaccaagtacacgtaattgtgcttgtctatagacttgagcgttacggtaatcttcatcggtttggcctcgtactcgagcagcggtcgactgttggcacccatcgtggtgcgttgctgataccaagagtagtcgtaaaagtattcactcttgccaaaggaaatgtacatgtaagaggaggttgatgtagagtttgcattcaaagtgcctgccggtattgttagaacagtgttgtcgttgtggttagttgcggttgtataaacagtaggcgtatttgtagaatggttacaagtattaggattattaggaacaattggtaaaacattgagatttacatcaataatagtggtagtagcattgttggtagtaacattgttggtagtagcagcagcactagcagcaggaacactagtagtaacaacatcagtaacagtagcattattgttatcattattattattttgcatattattatttttaatattagtagtaaaagtagtagaggtagtagtagcagtagtcgtagcatcactagcagctcttttagatttagacttgggtttgggtttagctgcggccaagtgctcgttgtcgctgcaacccggtggtatgcgcatcgtgtaaacgttgccgtcgctctttgccgagtacggtaacggcaccttgtcaatcttgtcaatcttgtacacgtccgtgtacattggtggcagttgacagtttagcacatcaatcatggtatcatagagtatgatgctgacatccacattgtagtaaatgtgaacgtttcggtttctggtcattacgaagccgttacgctcacatataccgagtccgggaaagctagcgtccaagactcgtgtaaagtctcggtacatcatcgtcagctgggtaatgggaatctcttcgataccgtcatcgtccgagggcttcaagtctagatcgaagcaaatcttaaactgataattgtggctcattggtatggccagagtgtggccagactcttcaaagtagtcacgcaacgtgtccagccggagggcatcgttgcgcactcggaccacttcaccgtttaggcaatcgtacaggcgaaccgaaaaagagtcagtctcctcggcccgattgcactggaggaaccttgtctgatttctggcaatatcttggcagtatgcgctattgtagttgtgatcgtagtctatttgggactcttgcaaaatcactgtaggcgtaggttcatagacaagagaagagtacattttgaatctgggcctcttgttgttgttattacccttgtcatcgttggacttttcatcgttggcaaaacgtttcataatgatcggtactatcggtaaatactttgacaagtaccaagtgtttatagtattaggtattgcgataattgcaatagtctatacgttcagtttgttaaaaacatcaaatctcggcaagactatgggctcactcaccgatgaggccaccgactctacaaagtttaacgcatccttctttgagatttacgacaaatccaccgacgactactgtgatcgtctaattctggtgcaaccgttcaattggataattgtggccaaaggtggccagatgtacgccctgaccgatgtgcagcacaagtgtccgccgaccaccacgcgtgccgtcaaactgcactcgaaccaggacaagttcaagtatgtgtgcctgtcgttgaccaagatgcagctgattgagctgtatcgcaatacggcccacaatgtgctcaagcttacgttcgacgtggacgctctgcaatcggacgagaagaggttcaccattttggatgcatgcaactacctgctggcacagggctacgcagtattggacgtaaaggagggtgaaaaggtggacaacaccaaagcgactaaaccctcggacaaggatgtcgaggacgatgctagattcagcattctaaacatgttgcgtggacagaatggcggtacggatagtggcatcaagagtgtagttattcgtgacggtagcgatgcgagaggtggtttgggagacagtgttggtggtagcttaggaggcagtgttggtggtgtaggaggaggtagtttgggaggtagtttgggaggcagtgtaggaggcagtttagaaggtagtttaggaggtaaagagcaatctaaattagacgatgattccaactccaagattgcaagcattattataccttctgatgctaatattgactctgtttctaatactgagattccctctgttactaatactaagagtgccactgtttcgaatactaatgttgcctctgtttccaatactgacattccctctgtttcgaatgctgatgttgcctctatttcttatccatctggttctaatattgcctctatttctaagactgatattgcctctgtttccaatacatctagttctgatattgaatctggttccaatactaattccaagattgttactgacgctaaatctaatgataaatccaaagacaaaaccaataacaaatccactgacacatccaaagaccaatccaaagacaaacccaaagacacgaccgattccaatattgatgataaatctgattccgagtccaataccgaatatccaatcaaggtgattgaaattacacaaccaccaccagagaatgtggacactacaaagctagactatagcctactgccaccaccgaaacccattgaagtaacgtacattgatttgagtaaggagcctgaatctactggagattccacactacagccaacacaaccacctcctcgtacaccgacgccaccttctacaccaccgcctcctcctacaccgacgccaccttctacaccaccgcctcctcgtacaccgacgccaccttctacgccaccgtttgttcctacatacaatccacccggaggtgtggtagagtacgatggagctgccgatttccttgagctgctcgatgaggacgatgcagactttgaagctataaaatcaaaatccaactctcgcaaaaggcgcgatctgtctacacagtccaatgatggtgatggtgatgatctaccgccgttcataatcgatccggtcaccggcatcagacgtcgcaaagtgaccaaactgcccaagccgctagaggttgcagcgcccgagtttcgagactttgccgaggagaatttcgatcatgtagagctacccaagggctttgaactaccgctcggagtgagtctcaaattggccaagcgttggcagcaaattctaaactactaccaggacaatggaatgccaactcacagagcgcaagatgcctacgacatgagcgatgccgagtgtagagcaatgggcaaggctctggcgggctactaccatcgcagccacgacccatctaaaccgcccaagtttgggccaccaccgaatccagagattgactctttggtttacaaaacgtattagtttatggagtggcttgtgtttaagtttctaattctaattctaatttatataattcctttaatttctagttttgtatccattttgcatgccttgtgtaccactttatgtaccactttatgtaccatttttgtgttttttgaaatgtctttgtattaacaaatttaatagccattataatatttcaccttttttaatcaaaacccaaataagagtacccaaaaaaataactagtctagtttgtataatcgtttattagagagattcaaagagtatgtatacagcgtttaagagatttaaagagtatgtagacatggttaagagattcaaagagtacatagacagaggtttccaagattaaagagcacgtaggccgagttacatagattaaaagagtatatagttacagagtattgaattagagtttcagagtattgctatttcagagtagagaacatgtatatcgagatcctttcataatacaggtttactttgagattcataatacaagcttactttgagattcacaagagattcataatacaggtttactttgagattcataatacaggtttgctttgagattcataatacaggtttgctttgagattcataatacaggtttgctttgagattcataatacaggttattttacaaacacaagatattcccacactaaacatcctcatcctccaccccccctatgccatcgaaaacaaatgagtaacagtctgggactctttatagtcaaactcacgatcagtcaaaacattgagcagcttggctagcacctccaattgatcgcgcttcaccagctttggcatcgatcgtagattcttcttgtctgcattgcacttgatgcaaatattgctgacggtaatctcttcgtcgccggacctggtctgttgctctatagtcttgaagacgtgatcgcaatcaatgtcaatggtgggaatctcgtcgggcctcttttccagaaaacatcccagactatagtgattgtcgtacactttgccggtgtgagtcctaaagtagactcgctgcgtgtccggatcacgataggtcatgcacaacttttcaaactttacacgagaaccctccttttcgattcgagtcttgaatcgttcagtgggcaggctaatctcattggtttcgcgttccttttgtagagactcgtgaatcgctacaacactgggatccgatgtcgtaaacgagtacagcactgtagagttgctagtattcaaagagagtctaatgttgacaatcttaaaattggtcttgtactttcggtaggcatccaaagaggccaaccgatacagtgaactattgatggtctcgctattgagcaagtttgaatctatgctaaaatgatcctccagctcgtacacattgagcggattattgtgctgtttttgttcagattgcatcttatcagcaaatgttgatttccgctctaaaagtacacaaccgctctcgtacacttgcaaaatgcaaatgataccgtgctttgaagggcttcagcttttatctggccacgggtggttgtttttttcaacctctctacttgctacatttgagctttacaccaataggatatacgctattgaaattgtttagaaacgttgatggagttattgcgtgtctggggtacgagtccatttcgtagagagtgagactagtagcctatagattcagtccaggtaaaatgccatccaccaccaacactagtcgtaaaacccctaaaccagcatcaaagcgattctccactggcaattttaccaattgggattctccgaatagtggcatcgttaggcttctctccgatgccaagtgcagggtggaatcctacaaagagctgcctcatcgcaaatacaaccagtgcgactacaaacgatggatgtcgcactaccaaccgatgcagtatcgctaccgatgctacctggacattgagcccaccggcaagatgtacgctctcgagtgcggagtcgaagccgtgcccggtatacgggatctgaccgtgctagtggtggactcgacagtggcacaactcaccgacgagcacattcgaagcgtgtacgagcagctcgaagagggtctcgacatacgaaccgattccatctatgctcgatgcgtcaagagtgtacgcacagatttgcacttgcaagtgtttgacgagctgcattcgaggttcggttcgagcatactctacattgcccacaacgggttccagtacgatttcaaaatcatcctggacctgttgaggcgcaacgatcgagcctactggagcgacatggccttctcagactcgttggtcatgatgaagaatcgcaagggtgacgctaaaatctctagctacaccaacagtgctctgttcaagatgattcagagcgactggcaaaactactatctgctgacaaagatgcactcgtccattggagatgtgctcatgatggccatctggacgacgagtctaggggtttacgaggcgggcagtcgagtcgcagtgtgcaccggtgcacgtttgtgcgacgtctacaaaaaggcggtggctgtgcgcaaaccctccagactcgtcatacgcaatccctttgacaaacgctaatctattgtttttcgaatgcataactcgtacacggtgttgtcggtatctatactggtcagtttagtgatatgcacattgccaaatcatgtttctcaatcccatcacttttggctacaggacgggtgcgcagcacgatcctctgcaggatcggtactcgttcaacgtgtaccgtgaacgcaccaagggtcaggtcagtgtagacgccgacaactacctcttcaagtctacttatttttggatcgcaccgtacatgatcaataagcatgcgactccggtaaactttacctttaccgaccgacgacccgagactacaaacgcactcggcagcgtaaagagttctcaaatcggtccagtgttacaaccgcaacagcaccaccaccaacaacaacaacctactcagggacagggtccggctcaggcgctctttgacggcatcggcacttcggacaatgcgatgggatcgattcgtatagtgggacgcaaggcgccggtggtggtgtttcgcgatgtgatcgatttccgagtagacgatcccggcacaatgtccatggccgactatatgcaactaaagcaatcgctggaacgtttgaattcactcatccgagacacggacaacgtggtcgacacggctgccgaagaggagcgcatgagggccaccctctaccggttcgccagagagtctagtgtggcgagaaacgaacgcgaatggatacgagtgctaaacgccaactatccagaggcgatggccagactcaacatgtacggtactgggggaatgttgaatagtgacgatatgcaggtagaggttgataatgcaattgacgagtatgatgcttaggttgtggattattgtagtgttagtttttactagtggatgagtttgtacgagtagatgtccttagtttatatttgtactagtagtcttgtaaaattatgtgtagtagatttgtaatgattgcttgtatttttttaaaacacctcttgtcttttttggaaccactcttgtaatttaaaacacctcttgtcttttttggaacccccccccctacatttccatttttcaccaacattcaatgctagtatactcgcaacactcgagtgtggcctcagaggtatgctctcaaacgcctaccgtgcaaacaatagcaagagtacgggttgcgtgaattttcaacatttgcgtgtgttttgcgcattttcatttttatagagtttgtgcactatagagccaatacggtattggggttatattgtggtgcaagtattatgcggacgggctcatttgaccgtctccgtgatgggtgtgcattttgcacggtacggtgaggtgtagtgatgtgcatgaaatgtgcgcaaaactacactctgtgacatgccgtaatgtgtaaaatgcaccctattgtgaaccccttcggttcaagttttagttcatactttttaaactcgtaattttaacacgaaattgggtacaatttcacgcaatttcagtgcaatttcacgtacatttggtgtgtttgctctgtaaattacgttaggcgttggctaatctggcttaaaacttggtcagaaaatcatcaaatatcaccgagtgtgcagatggctcattttgagcactttgcgcactttggtggtaaaatcgacttttgacttgcgtgctgtcctgtttcgcacaggcatgcaaaaacagcgtttttagggcttttgaagatgatactgtagacggtggttttgtgcacttttgacgactttgggtgcaattgctatagcagtaattgcagccatttgtcgtacaagatgcaacaaaagtatcgtactatagtattatttgggggggatactatactataatatatattatatatataggtactgggcgccgagttctatttttttcaactcgtttttgttatatttttttaaactcgattactgaattttaaataatactaaaaaatgtaaatgtttctatgtatttatttggtagaataatggtggttacaagtatgtcttacagttaccagtatggcttacggttacaagtatgtgttacagctacatctacaaacatttcttacatctacaagtatacgcacatgcaacaatatacaatagcatgcaacaacatacatcaacatacaacaacaatccccccataaaatctaaatctatcccttgagcttaaacacacatccaatcataagatccaactcgtgcatggcctcctccacttcggcacgcgtagacggagtcagccgatcggtgcgtctgcgcagaaacgtcaactgattgcacatgctgctggtgccggcttgcaggttgtcaaacgacacctcatagatgccatccggcatattgtcatagtgaatcagattcagcgaatcgtccatgttgttgctattctttacgtacaccatgccgttcatgagcttcacatcaaaggtgggaaacttgaacttgaactctttgttgcgataaatgacaatgagtccgtctcgcttaaacttggtggttgcgttcacgtctatggactcttgcaccaggatgcgtttacagccatcgccaaagtttacatactgctgttgacgattgaacgtggacagaaacttgagcacctcttcgggttcgggcataaacagttgaccgccgagacgcactcccagcacgtctgtgattatcactgtgggtatgccctcggatgaggattgcgattcctttctgccgttggtgcacatgttctccaattgaaagtacaggttgggtacagtgttgaagattgacgaattaaactgtataaacttgatgttgtcatcctgatagagaaccttgttgggctcggtgcacaccagtttacacttgaagccatcgtacttgtgcttgtagatgaagctcttactgtcgcgtatctgcaccttgtgaaacttggaaaagactcgacacggcatcttgaagacggaatcgtgcgtggccggttgcaatcggtgcagtacgcacattatgtttgacaccacattggaggcaaagtactggcccagagtgtctctgagttcgcacaccagtgccgcttcttgcatgcgcagtccgtgaaaatcattgagcacgtctagcgtgtactctacctcgcccgatatgtagtactcgttgccggatccgttgctcctgcactctagactgatgcgaatattgttgttgcgaaacagcacaaacctttgcaccatcgacgagagatcgctcatggatgccgtaaacggcacattctcctctatcgatacggtacgacacatgggaatcacaatcggtgtggccatcgtgccgctcaggtacaagtgtcgggatttggagattacgtgtttgcgctgagatgtggtgccggtgactcgagtgttgtccttaaagtacatgacccacacttcacgatgtggcaagtctacgcgtgcaatgttctttttgatgcactcgccaatgtgagtggagactggtagtgcaaagtaggtttcgtactccatctcacaattgggattgttctcggccatggatgcaatgtgtgccagagtcttttgattgggagtttggttttgcttttgattttgatgttgcttttgagtttgattctgaggttgattttgatgttgcttttgagtttgattctgaggttgattttgatgttgcttttgagtttgattctgagtggatttggaatcctgagttggaggttgttgagctagactcggcttggactctttgggttgtggctgcttttgcttgggctctttacaatcctttttagccatctcggtattggatgcactcttgttctttacacttgatgcagagtgcgcactcttggcattattattggactcgatgcccgagcttgtactctttgtgtttgaattcaaactgtttgaatttaaacttgaactctttccactgttggcactctgtgtactaatggtactctttccactttgcacactctgtccactaatggtattctttccactctgtccattattagcactcggtgtactcttgccactaccattactaccaatactgctggtagcactctttgcgctaatgttgctcttggtactatttgcactaatgttacttttggtgctctttgcactaccaccactaccactactacctgcactctttacactgccactgctaacactactctttggactagcgctaccggcgcctacactcttttcattgctactctttacacttgtactagttgcactatccggactcccatcctgtggactctttacgccatcctgtgtgctcgttggactctttaaaccggcactctttgcactagattcaatcgcactcttgattagtgcattcttttgatttatactcttttgatgcagaggactcttttgatgaggtgatgtactcttttgggatgtactcttttgggatgtactcttttgtacactactcttgtgtataccactcttttgtaaagtactcttttgaatcgcgatactctttggattcagtaaactcttttgacttggaggattcagagcagaaccggtactctttaaagtgctactattggtactctttgaactcggctgcacaggcttgggaatctccgagtcctcatcggtggacgattgagtgctatcgaatcgtttaccgaacccgttgccatcgccgaatcctaccgagttgaaattgttgactctcttggcggcaggatgcgcatctgcgtacgcatcctccgaactcgatgacattgaaaagttggcagacctcttcatgatcgctgccggaagtgtactaaaaaataactagaccacctactgaattaaatactttttctaaaccctgaatacgtgcgtgtagtatcacgtacaatgcaataataaatgtgcacaatgataatttcaaaacatgtaaactacatttgtttagtaggtgtttagttttatatcctcaagataagactggtagctatgagtaagtgtattgtacaattggaggacaaggtcgagtgtaatcaaaactcataacgagttgctaaaaaaatagcctttattgttggtattcaatagattacagaattgaaaggttacagagtacaatggtacatttttgtctaaggattgttacaaagttgactctaaatctatactctaaactaaactctaaatctatactctaaatctatactctaaaccacactttgttcaatcttgaccctctttgcagcggattccccatcgagtccatcgtcctctgccagaacagcctttacgtcaagtttgcgcttttgacaagttccactctcgagctcctccaagcatctcgtttccatcatctttttgcgaatgtcgtccatgggaggacgagggtgagtacgcaacagcttcttgtactcgtcatagttggggtttccgcgatcgattccaccaaagtcaccgatgcccttaaagtcacgctgcaccagttcaaagttgccaacaatcaccttgggtatgaatccgttgagcgatagcgagttggcggacggagtctttctatagtagttgtttccgatgaattgatcaccgttcaggatggatctttgcctagagaacggcaacactccactgggaatcttgtccagtgttttacagttgctaatcttccacaggttacgatcaaaggtggagagatcgcgacgacagcccatgtgcacgggacgcaactctttggccaccttgggtgcatcggccggcttggtgtgggcactcattgcggtacgatcaaccattatgagtttaatcttgagatcgatgctgaggtgtgagtcttgtttctcggcatcgttcaagtctctgagtttggcgatgacaacaccaaactctccggcattgtgagtgtccaatgcgaacggagacacgatgattggtgcatcgtcggtcgcctggtctgtgatcacgatgcacgtactcggcaccgtgatgaacacaccggacaatacgactccgcactggtagagtttcatcgagtctacaaacgcagaaggcactcgcaaagtcagagtatcgctatccttggccgtcagcagagcctcatagggacggtccactagacgattcacaaacacggacaccttggatttaccctttttggtcttgatgcccttgaggagcttcttgtagtagtctttgcatttctgaatgctgcactccgagtctacgttcaacaaagtcttgaaagtgcaagaagccattttttattacaagtgtttgagtagtctcagttattaaagcaaagctttacaatgctcgaatctatagaatatcaccgccttttaaggacaataccgtattatcgatatgtttacgtttgaatgttatataaaacactttgcgcgtacggtgtcgatacagtctgccattgttatttgtagtgcaaacacactagtggtagagctatacctatactttagcacgacacctacttcatctacatttgcctactctttacctactctttgcatacttttactaccggtacctacatttaccaaccatgaaacgtagtggagtacacaccattgaaaatgtcaattttggcatgtttaagcgtcctcgtacgatcaagggcgactttgagacggattggtgtgtgctcaaatttaggacctacaaatcggtggcgtgcaatgacttggatcgaaactatatacagtacaagagtcaggtgcactgcataatcaacgagtttaaaaaggaactctttctcaacaaggttattgaagagtacaccgactatgcactcagccgggctctggacgattcatcgacgttggccaagctcaagggtggacaaaaggtggtaatcgacaatgcaccgaatcgcgatgccactctgcgcaatctgagatgctgccaccgattcaacaatggcgtttgcgcacagtgcaagatgacccccgaagaggccgaggcatcgtttgtgtctctcaaagagtgcctgtacgttaccaaggatttacgcactctggactcgtacaagcgactcgaagccgaaatggaacacaatgccattaggattcaagaggattgtaaaaagattaaactctctcaggaggatgaatcgattgcacaaaagtacacggatgacattcgtgcgtacatgagacactttaagaatcgcactctgctcgagtacctgtgcaatcgcgagtgtaggagttttttgatgatccactatcgagccgagttggactacatcatgagagtgtaccagtttttgagcagcatcaatggtgcgaatcgtttacgagtctacaacaatccccagcctgaggaggcggagggtgacaaggccaaacgcaacaaatccaacaagatggaccatcgcatcagacaaagctacaagcacatgatttactattcaaagaagaacaacaagagttgcctgcatcgattgctcttgtcgtgcaagcgtgaagaggtcaagggtttgttggattttctacacgacaccaaaccgatgaactctctgtacatgcacacgcagatttggtcgagcttcatgaacggtctaaacattaccaagaatgaaaagacctttaaagagtacatgaaggcgtacatgcatcgcagatcgttggtcaaaaacatttaccaaactctgaccgatatgaatatggtgccggccaagagcggtttcgtgtacgatctcatgttggacaatcgcggctatagttcggtaaagatttgcatcaaacgcggcgtgcacatgctctcggtgaacggatcctactatcgagagtttagggatctctacaatacggacgttgacgagttggagggagtgcacgtggaacgtacacccatcatgatgaacaagtacggtccggtgattacgacgggaggctctagagcgctgaaatcgtacaacgtggctcgctcctacaagagtctgtttgcccaaaacactaccggcaacttttacaaaaagacgatcgattactatgtacccgctagtgaggtgtaagccaatgtgtttgtgtatgcatgtattgtattgtattgtattgttaagattttaattaaaattactctatattttgtaatttaattcatgtaaacctgatgttgttttattaaataaatccacttgaacacaatgcgtttagtcttttttcagatgatgtattagatacaatacggtattggtatttgtctttgggtaattattaaagccttagctagtttagcttgaaaatgagtcagaatcctagaatgattgtcaaaagaaacggttcagttgaacgattcgatccatctaaattgtacgctaggatagaaagatgcatgaccatgtccgagccccgattgaccaccgcctttatcaacattgcaggcatcgtggccgatgtcgaaaagggcctgtacgatcgagtctcgacattggagctggacactctattgtccgaaacttgcgcctccatgtccaccgcgcatccggaccattcgatactcgctgctcgcatagccatgcaggcgctacacaaacgtactcgttccaagttttccgaaacgattcgagacttgtacgaggccaacattgtgccccagtactattttgacttggtacaagagcatgcagacaccttggactcggccattgtagacgatcgcgattttcaatctttgacctattttgcatacaagacgctagagcgtacctatctgataaagctggccgacggtaagatttgtgaacgagtgcagcacatgtacatgaggaccgcgctcggtattcacggtcgggatattgaatcggtaatcgaaacgtacaatctactctcgaaccgctactatgtacattcgacgcctactctgtgtcatgcggcaacgaatcgttccaactatgcctcttgctatctgctcgaactcaaagaggacagcatcggtggcgttatggacacgctaaaggacgcggccaccatttcaaaacactgtggcggtgtaggtttgcatgtgcacaagttgcgctgtaaaaactctacgattcattcaacaaacggcaacgccagtggcctagtgccaatgctcagaatgtacaatgcaatgtcacgatacgttacacagggcggcaataaacggccaggcgctatagccgtctacttggaaccttggcacgcggacgtttttgactttatcgagatgcgcaaaaactctggctttgaagaggcacgagccagggacttgttttatgcactctgggtgccagatttgttcatgaagcgcgtcaacgacggtggctactggagcctaatgtgccccgactcgtcacccggtctgtccgattgctggggcgaagagtttgaggccaagtacacggcctacgagcaagagggccgatacgtgagacgagtcgatgcacgagaactgtggaaggccatcgtgacggctcaggtagagactggaactccgtacattctctacaaggataccgtgaatcgcaacagcaaccaacgccacttgggcaccatcaagggctccaatctgtgcacggaaattgtagagtacgcctctccggacgagacggcagtttgcgttctggcatcggtcaatctgcccaagtttgtagagggtaaagtgtttaatctcaacctattggcaaagacggtgcgtctggtgactaggaatctaaacaagattatcgacaatgcactctatcccattccctcggctgccaagtcaaactttaagcaccgacccatcggtataggagtgcaaggctacgcagacgctctggccatgatgggtatagcctacgaggactcgatgcagttgaatcgtgacattttcgaaaccatctaccatgcagcactgacggagagttgccaactggccagagtgcacggagtctacgaatcgtaccacggtagcccgaccagtcgtggagagttgcacttcgaccgatactcggtgcacagccaaaagtgtgactggtcatcgttgcgcaaagacattgctcggtacggtttgagaaactctttgctggtggcaccgatgcccacggctaccacttcccaagtgtttggcaatgctgaatcttttgaaccgttcacgtcaaacatgtaccagagacgcacccagtctggagagtttcaattgaccaacgtgcacttggttcgagacttggaacggctcaatctgtggaacgatgacatggcccagttgatcatgtacaacaatgggtccattcaaaacattaccatcatcccggaagagttgcgcagaatctacaagactgtctgggagattccgaccaagacgctgatcgatatggctgccgacagaggtgtctacattgaccagagtcaatcgttcaatctgtacgttgccgagcccacctacagtcgtatgacttcgatacacttttacgcatggaacaagggcctcaagacgggcatgtactatctgagaacaaagtcggccaccaatgccataccatttacggtggacgtgaatcgttgtgccttgttgatgagtcaaatgaaggctggcagggttatggcttcaccgtttaccaagtctttgttggtggttgagggtagtagtggtggtgttgagagtactactactggtagcaatactagtaacagtactactagtagcagtactagtagtagcaatcctagtagcactcctagtagcactggaacaaagcgcaaccttagtcgtaccatgcgctctaaacgttcactgcatcacattacgtttatgcaacagattgcagagaatccaaccaaggcgccactaaaggctaaaattgatgcagcaaattctgttgagaatttaagtaaacgcaaagagccttcctttgagttggtcgatagtgatgctaaaaagatttgcatggatattgatgataaatcaaaggatgatgaaaacaattctcaaatgtgtcaactagagccaaagccaacagaggtaaacgaatcaatagagccaaaggaatcaatagagttgactgggcgcaatcaaatggtttgttttgatgatgtgtgtacgtcgtgttcttgttagaaaggttttgtaatttgtagagttggtttatatggttgtagagtttagtagtttaaaaaacatttaaaaacatttaaaaccagttaaaaattgttatgtttaaaaaatatacatgaattgtttagttgatggatatacatacagggttaattataaggtagatgattgtacaagtggtttgtgtacatgtagtacttgtaaggtattttataaggcattctataaggatgtagacatttaaacaatctatgcttgtaataaattgtttaataaacttgtttaataaacttgtttaataaaaactaaaatacttgttgttttttagactctgattcaatccaattcaattcaatacaataccatgcaatacacctccctccccccatcaaaacccagtcacaatataggtaatcttgctgaccacgttcgatagagcacaagcatcgtgaaacttttcaatcttggatcccaacacttgactcttgttggtgtctagaattataacgttatagtgttgttgttgctgagtggttttgattagtttcttgatggtcgtgcccagagtacggtagccattgttggatggatacattctaatgtacatggacgacggacacagtttggtacgttcgggcacattggaaacgtgcaagagtatggtgtcggtgcacttgcgtgcatgtcttagcgcaatagtagcgatgctcttcacgttgtccggcttgacaaactctaggtccataggcatgatgattaatggcacatttcataatggcaaccttggactattgtaataacacattgtcactatcgtgctaacggaaacgtttggtgccatgaaacgacttgagccgtattcagtatataattggaaaattgcaaggtatagtattttacaaaaacaatggacaattgtaaagatgtcgtaaatgccaggagtcatctgtacaacaacgaaggcaacagtctcagaccgtactactatctgtttgagcgcagcgatgaacgcggtctctttaggttaaggttaaactacaaatatcacaagattcgtcaaaagcattacataaggttcaccaaacagagccgaggcttcagcaacgagtacattagtcaatccaacttaatgtccctattcaagattgccatgtttgaatttctaggtagatacattgtaaacgtaggcagcatagtttcaatcaatcgtaaacgcatacagtctacgaccgtggacctgggggagcaagacgattgcggtcacgtctggtatcagggattcatgtattccggctatgaaacagtttacgatccgctaatgtcgctgcctcagtcgtcggagcccacttggatttccgattgtgcaccaatcgtaaaaatcgttcattcgttgccggagagtgtcaacattttgagtttttgcaagtttgtaagaagcgtcctattcgacgaggatgacgacgccatcatagcaatgaattacccaatagttagaatggttcaaatcaccaatgagatattgcgggtatacaatctaattagaataaagggtaacttgaacgaatctttagagtatctaaacgcgtcaataacgcccactttgtacgatctagagtttacaataggtctgatgcgatggagaaaaagcagctaagcctacaagagtacgacactgagcaaccaactcacgatctgccacaggtgcacatttacgctgcagtgtcgtgcaaccacaccatagactcgatgttcaaccagagtataacttgcaactatcagtacattgttctgggcaatcagttgatgctgtttcacgtaatctacttcaagtacgggtgctctaggcagttgctcaaagactgcaccaattcgaatcgagtacagtaccgtctgaacatgaagggtgaagtggaacgcatctacgagagcctatcgtgtccggtgctgtgtagtgcagctcaactgcagccggcctcgtccaccgttgtgggagtgctgctggacagtatgctgatgcaaaacctaaagttgctcttttccaattgtacacacgcactgctcaacaagagtcccaaactctacttggagaatgcggtgcacgtaaacggtacgagtgcactgtttctcttcaacaacatgatcaaggtggagaaaaactttacggtcgcactcaaggcgttcatcaagaatatcaacaatttgattaaacagtttttgtttgtgaaaaagagtacaggcagtagtagtagcagtagcagtagcgctaatgctaaaaatgccaacaatagtgcagtcataaagtcggcagtgtatccgtgccatgttaccaattcgtgcaagtttaaacagatgcgtaccaagtttgaatcgtacgatcacaccagtgtacatgctgcactatgtacagccgacgccacactagttggtaaattttccaatttggaatatctgattctgttgaatgaaacccggacggtatttgaagaggtgcgaaatgtgttgcatgtattggattgagagaaagcgagtaccgtttaatgcaggttttgtgtaaggggttttgtgtaagaggttaatgtagcaggatgttttatgtaggcaggaggttttatggaatagaggttaagtctatttaggaggcatctatctgtatagcatctgatactaaaggaggattaatgtcaagaatctaatgtcgagaacctcaacttgctgtatgtataggtgtctgtatggatgtctgtatggatgtatggatttatgtatatatgtattttgcatgtaaataaaggagttttaaataaaagattgtaatataaagtcaagtagattttaatgtaatagtgtagtttaatacaattgggtgttataatctaacaagtaataatgtaattgtataaatcctagttttagttttttaaacactacatttgattatattttattaaacaacatttggatattaaaaaataagaatgaatattacaagaatataaaactataaaacataaaactatagaatataaacctatagaatataaaactacagaatataaaactaaagaatacaaaactatagctaccataacactaaacaaccattctcctcctcctcaatcatccatcccaacattgacatcatcatcgtactcgtcctctccgtcaccgtccaagtctccgtccccgtctccgtccatgtcgtcctccaaatcagaggcctccgattcggcttctagcttttccaaattaccatcaacatcactgtcgcactcttcagatttgacacttgcattgtcatccgaataatgcggctgttcattgtagtcggcatcttcaacctcagacttgatgtccttttcagttttaatctcagacttgggctcacactttggcacatccgactcgtcaatctcagagcccgaacctcctctgtccaactccgagtccaaatcactactgttgtcatcgtcgtcggtaaatctcaatatggactcgtactcggaatccgagtctagatccaccggtgcctcgttgctcttggatcgtttaggcttgtgttggtggtcatcttccagtttgcgtttaatgctaccggtactgttgcttctgaccacatcctttttagcatcctttgttgttttacactctttgcgtccatccttcaattgcttgcatttatccttaccaaacaatgcagcacccttgctcttggtctttttgcacttttcaatcaatgcaaaggctccctcctcgtctcggcctttagcttcaactttggtattaccactaccatcgacattactaccactattgctactactaccactgctactgctactatccacactaacactactcccatcgccaccaccaccgccgcctccctgtactgccttcaagtctgggctcagattcaagtgcacatggcccagtttgattagatccagtacaaaggcgttctcgttgatgctctcgttgagcggatactgcttggacatgagattcatcgtggcaatcaggccattggccacgaaaccattctcggccgtcatcagatcgttcttgggaaacatttgcttgcacttggcattggcctcgatctggtgcacgaaaaaggccaacggggcacaaatctcaccgtcaccgttcaccgccaagtctggactgttgagcatgctcagcgtctgcgacgacgtggtgcgtcccaccagagattgtttgctaaacaatatctgcggatgcaccatctttccggacgcggtccaaaactgatactgcgacagatccttcaccgaagacacgatgcccttttgtccgtgcagattggccaacttggtgccaacacccaaacgttccgtatagtggtagtggatggagatcatcgacttttgattggtattgttgatttgaaagaaagagtctatagtcttggatttgcgcagtggatcactcattgtaattagatatctaaaagtgttctttataaaagacttgtgtatatagaccgatctgcgtcgctgtatccgtacctggtggtctgtgatgagcactccaaacacaatgactccgtcaaactttttattgatcggtatatacttgtaggtgccgttgggcttcagagacatggccttgtgcgaaaaggtggacttgtcgtcggtgtgagcgtacaccctcagcagtagagtcaccgaaaacagtttgagtggcgagttgcgatgaaagttttcatctataatgatgccgtcctctacactgtcacagttgagattgcacagggccgtgtacaagagcatacggttcgtgttcgagtacgtgtccaggttcatttgcatgcactcttcgtaccgagactcgtctcgtttgctggtgctccccggcggtacgggtaacacattgtagtcttgcatcttgattgtgctcaactgacgctgaatgcactcaaagtgttcatcggcatcgtgcacaaacaagtctcggtagcactggccctcctcctcaaaggtcttggcacccaccatgcaaggatccaataaatcggccctgccatcggttatggccaagttttcacgcttcagcctattgtagtctttgaaaaactcgtgcaccgtctcgggagcctccatatagtactctttgcactcgggctgaatctcggccaaatgggtaaactttgtggccgccgccttgatggccagcataaacttggaggaatcgttaaagctgacgcactcaaactcttcgcccaattgacgttcgttttctcggtcgtcgtcacaatcggtcaacatgccaatattggtggtcatcacggcagagttggtgaatccgatcgagtggatgaatgcgtgtagatcggatcgactcgtcagcgtagagcatgaacccttgatgttgttgatggagacggtggcctttgccggtggcatgtgcaacagggctcgatgaaagttcatcgcaaacgtagtgtaggccgcaaacgatgtgtagccctcaaaggcgtctcggtaagtgttcatggcctcgtgcacgcccacaaacatgcgatacttgggcgaatactttaccggcaagtggcccacatggtacacgaccagatagcgatcctcgtacaccatggtcaccacgatcatggctcgcttcatttcgatgacatcgcacggccgaatgcgatagttggtgagccagccctcgatcactacgcgcaactctgcctctggactgtggtggtcgttcaaaaagtctacgatccgctccagtgaaacggccggtgcaatcattacaaactgcgctagagccatcgtctcgccggcattcttcatctccttgacgttgagcggacagataaagttggacgagtcccgtggcagtttgagtgcattcgagtttttcacaccgtgattaatgtgtcgctttaccgtactgatgagtttgtcgatcatcgacactcggtggccctccaccgacaggtaggccgtcttgaactcgtcattcttgatgtagctcaccgtctttgaggatagcgtgtaaaacagattgcccgacaccagagtgcccagcttggaagagttttgcggtagagtgctccatttcttgatggccgtctcaaagatggaggtcggtgtgattatagtcttgttgcacaaatcgtccagctctggatagttgttgatgctgcactcaaaaaaatcaatataatcctctggagtcacagtgtgtgcattgtcagtgattgcgttcactggactcagacgatttatgagtgcaaagatttcctcatcggtattgtcggccactatgcaatcgtccttgatggcatagcctcggactcctacgcgcttttccgtcattcgtttcgtgctcaccagcttgactcgagtgttgaccgccgcaatcgtagagttgcccttgcgtctgcgcctactgcccgattccacgacgggtgattcggccacattgggcggatactgaatcatgtgcacaatggtactgttggcatcgtcgggcacgtcctcgttgagataccacttgtactcgttgctcggtctgtacacgtggccgcatcgcagattgttggtgatgaaggccggtaaaatcttgatgcctccgttcaaaacaaaggctcccagctgatgcttaaagtccacattgggtctaatcatcatgtcaatcttggagccaatcattatcggcaagaccttgtgcttgacgatcacttgattgttgctacagtgcaattggatgcatgcagcataagatttgttgtactttaacaagagccgaatcacatcttcgccgtctacgcgcttagactcttcgtagacgtactcgttgtagcaaggacaattgtagattatcaatttgtccatttttaggttgtactcgtcaacaatggtttttgcgtaaaaatccatgtttgctgctgaacgctaaaaagcgtgttaccgcttcaaatgttcaaccgcttactaataaccgactgttgatattacgctatttatactattgagactatgggcgttgtcattgtttatagatttagcggaaatcatgttctgttcaactagctcgcagtcgggcgctcagcggtgcatttttcaaaatgtatacgtcagatgcactctaccggtggcgggaatcatttgcaacccccatctgaatctgttgttttcgatgagtctggtcaagaatcgggtcgtcatcaacaatgtggccaagaccaaagtgtacatggctccgactcccaatctgaggggtgacaacaaactgattccgttcccgtactcggtgtcggagggcagagtgtgccgatcgccatccatcgaaaatataatctcagagatgcaggcatgggtgagccggctcgatgtggatcaggcgtctgcttgtcatctgactcagattctgacggtaatgtttaccgagaacctgattgcatctcaagacatgagtcgcaactcggacaacatgtacctgaaccagtaccgcgactacatgcagtacattcacaagtatgacaaatcactcaattctagatttgccaacactcgcatctttgcctacagccgaaacggatccatagagatgagcatgacgctgatgcctcagattataaagattttgctcttcaactgtgaggcgtcaaccaactacattccggaggctacatcgtttccacccaatctgtacctggatttggatgcgagagccttcaagttgatcaatcacgatatcgtggccaatccgattgcctactatgacgtgaaccgagacactgatgtagcgtctccgctagtgtttgccggtgatgctcgcgacgacgtcaatgtgctcttttcacgcaacctggtcaactttagagtgtccgaggttggaatcgcattgtgttcgtcttaggtgtgcgtgtttgtgtttgtggttgtttgtatttgattgtatttatttgtagttagaataatagaatagaatatcaaatattattatagaatagatggcatttttcaatagtatagaaatgtaatagtgtagattatccaatagtgtagagtatccaagtaaaagtttaagcaactatcaagtgtacattttttaaccaattcaaactcttggtcaatcaaaactcgtagtcaatatttaaaacccttatacgcagtcaacatccaaaactcttatacgtagtcaacatccaaaactcttatacgtagtcaacatccaaaaccctctcattccacattcaatcaaaacctcacattcaatcaaaccctctcattccacattcaaactaaatgtaattgtagaataaaaaataattgccgcatgtaggaatgtaaacttgattgcagtatgtagcacaggaagtgtactgattgaaaaactttatagcttaaccgagtttaatttttttaatcttgatacatagatggatgagaaaagatgcaatatctactgcctgcactcttggcactcgtaatgtgtcttgtgttttactttcaacttggcacagttggctgtgatggtaacactagcaaaaacaacaacaacaccaacaccaacaacaacactaagaatagagcaactctcaagacgggactagaatatggcaagcgcaagagcaactgttcggtggacaaggtgtattgtttcaccgatgcacaatgcctcaactcgtgcatggaaaagatgaatcacttgtacgattgtataaacggcatctgtgaaatatccatcaatagactcaaggagactgccatagttcagggtgagccgtgcaacactgaaaagggcatgttcacctttataatgggcgatccagcaatgggttcgtacatgagatcgtgtaaatccgtcgacttgggtattgcaatttcaaacacggaaaacttgatgtgcaagggcgaccccagtgccgtcatcaactaccactcggcgtatcccatcatggacgactgtaccgactgcaagcaaccgatagtcataccggcaacgtacaacaagcgcagacataaagagtgcaacaatcccttttatcgcatggtggagcacgaaaccaaactgtacgaggaacaaggattggcataaatggagacattaccgtttgcataaatacttgacggatacgtaaaagtcccacatagtttagaaatttgcataaatgtgtaaatttacaatttaattgccatgctagaaatccaatctaaattttagactttgtatgattataggtgtacaacttcctgtaatgttggttagagatggttattttttcaactttgtaaaaaatgaaggggaccctctaggcttattttttaatttctctaggctattaaattgcggttaattcatagaaaccggttgaataaaatattgaaattaaccactttgtgcagtttttagtttttttttgattaaaaaacacgaaaatgtcagtttagtttattgaatttacttgaaatcctacttcttgattaaaaaaatcaaacaaacacaaatacttgtaaatcattacattattacaaagcacacacactaatcatttccaagatttaacgatcttggtcaacaatagatgaccattagtcacagtctttgagtcatttgacccaaacatcgttaaatagcacgtcttcgatcgtctttgtcttgaattcaaatgaatttttgcacttttcaaagattttcaaaaatgccatgaaattcatgtgcgccaaaatttcttggcgactaagaacacccaaagtggtggtgtcttgcactacaaatgcaatattcttcttgtttgtattcaaaaaagtcgtcaaccactggttggacacgtgtcgatatctgtagagtttaccctccagtcggattgcgttgatttttctacctccactgggctttgtactgagtaccgtccgttgattcgggccctttgtcttggaatagatgcgtatggcaataaagtctgggtaggcttctatcaatgccacctcatcgtatcgtttcagttccgaatgcggaaccagttcaccagtgttttgattgataaaactcatagtttgtaggtttttattaatgtttacactacacacactacaccgactgatgtgtgcgcatactagtgagtgtaagtttagcgtacatataggttggatctctgtgagcgtccgtcaaataaattaccgagcaagtgcagctaatcagccagtcttgttcaagttctctattgaaagagtgcggtcgcgatagtctttatagtgtaaactcgttgcatctgaaaactacaatacgttatatgtgcgaggtattataatgggttacacgccgatcaagtccaagaggaaggatggtcttagattttttgatgatattggcggtcgtggtactactcttgttgacggtgacatttataagatgcgtcaacctaatggttcgattgcacattttgatcctgatgagctcgaacgagagctatctcgagtaccagactgcaactgttactggtgcaaatgtcgccgctaccccaccgacgccgccgccgacgccaagggacgagatggagctgctcaaggagtggagtttatcgtaaacggttagtgttttaatgatgtttttccgaatgtcagtcatggctcaaaagtaggtcaaggtcaagaaattgggtcagtgaactgtatagtacatttagcaagtgtacacgtatggaatgtagggtttttttggttttatttagacatggcattcaattttatgcacttgtatagattgggatttattggcaatttcaaatggttttataggggtaaagactggtaacggaggatggcaaaggatggaatgtgtaggattgcgtgtaggaatttgcgtgtaaggttgtgtgtaggattgtgggtgtaggattgtgggtgtaggattgtaggtgtaggattgattttaggattgagtatatgattgcgtttagataatgttggatttgtacaattgtttttattaatgtaagagtttatatccttgtatatcctcattccttttatccaaaggtattgtgtgtttttatcaagtaaagtacaagcttgtacaaagtactaacaattgaattctctctctcacgcaggcaccaaacttgatggtaccggagtggtctgtccctgtacgatggatcaaaacgcttggattggtcaacatgctttgatggggcagcaaaagggtccaagtgatcaaccgactctgatggagcaacaacaccagcaacagcaatccatcaagaacccgactgagccgcctctaccgtcttcggccagctactactattactattattactactactatctgaaccagcactacaataatggcaccctgccattctgtggagatgatgtcaattttaaaaatttgacaacaactgcaacggctaccagtggtggtaatatcaacaccaatacaagtatcaacactaatagcagcaccagcatcaacactaatcctactacaaccaacaacccatactcttcttcttctaccaccaatctactgtgcaatgaaaagtttattgaagatgaagagattgatccggtagagttggacgacaccaccaaccaagtctacattccgattcatgtcaatccggccaatagtgtgactgtgactgcgctcaaacccaagagagtgcacaagggtaaacgcaccactaccaccaccggatccggtaagaagcgtcaattcaatctaatcatgctgaccacgctgtacattacgtctcgtttgttttccgtggcaatgggccaagaggtgttgcctgcatccgaagccactccggcctcctctgaagctacgcctcaatctgaagctacaccggcctctgaagctacaccggcctctgaagctacaccggctactcagcctacatcgacttcaccgtcgtctgaagctacaccggcatcgtccgagacaccgccatctgaagctacacaagcctcctctgcggctacaccggcctcttctgaagctacaccggcgtctccggcatcagaaacgtctacagaaaccaccggtgcaagcaccagtgccagtaccagtaccagtaccaatcccaacaccagtactggaacaacaactacaacaccaagaggcacaactgttacaacttcaagaggcacaacaaacccagcgactacatccgctaaccccataactgcatcggccattccaaatccaatcaccatgtccccgatgccgactagcacggaatctcaaatgacaacattcatcattgtgttgcctcaccatactacaactacacccagctataataccgaggccactgctaccgtggtgattgtatcttgtgatatcagagatttcccttggttgactcgtaaactggccatagacatgtttatgaacggctacacggaccagccaaggagtagccgcatcgattcgatcgttagctttataatggatccgtttctttcaccgactccacgcaggagtgtcgtaaacaagattccctgtatgcaactcgtaaaggatgtcataaatatgaaatatggtcctcgcgaaggctaacattaacaacactggcaacatcttcttctcctccttttatgcagacatggctatgaattttggaccaagaatagatttagatttcatgtttttagaatgtatgtagatgcaatgtatgtagatgcatgcagatgcatacattttttttaacattttataaacttgatattttacattttttacacattttataacatggtggtgggatcggtagctttaggttttggtggtggcttttgattgtttattcatcagggatttttatagatttttcttagatttagttgctctaggactcggtctaggactcggtctctagagtttttataaacatttaatcattgtggtggtggcctaggaataaatgcataatcagtggcgtggtggtactggattacaacattattattacatttatttttagttgtctggtttaaacatttgcaatattattttataacatttgcaatattattttataatacagttgaaatcatataggttagaggtgtaaggttatattatataaaattgaaaaatcttggtatagggatttggtacttttccaatagtaataattgaacatgcatgtgtgttttacataatatttaaaagcaatacagatttaattgaaccatagggtgtaagattgtaatatgaaacattcatacagatgtgtcttgcttggatttgtagatggtttttacacgagaccgtttatccaacatgcatacacaataatcatacacatttgtacaagtatgtgatttttctgtttaacgataatttaggctgtagaatcatcgtaagaagtaaaacttgacacgaacaattgtacacacacaagacgattgttttttaatataaatactagagcaaagaggttttctcaagtacagtctagctactactactatctctaaattgtattctaaaaaatagaatctttggcagttttaaactctttggcacctttagcatctttattagactcttggcttgtgtttctcaatttaggtttaattgccggtttatttacacatttagttttattcaaacatttagagtttatttaaacattcaagttttaattgaacgttaagttttaattgtgtgttcaggtttaattgcacattaaagctctaacgtcgattttaggtttaaacggcatcaacagcaacagctctctgtgtaatgttttttattcagcatagtggtatcaatatttataatttataatttataatttgtaatttgtacaatacttttatatataatttgtacaatatttttatatatacatatcagtatttaaatgatgtaatttttgagccccagaatgtgtttcttttttgataggtgatgatgggatacagtaggtgtataagaaataccattacatgttttttataagaatagttgagagtatagaatagttgagaatataataatcctagcgtaatttacaattagtggtagtgtgagaatctacatttcaatttccaacctgcaaactctcgccatcttgcatctcctctgtccaacatcagacactctattttgcacattatcgtacaggtacacgggacaacgcaattgattcaagtggagaagatggtagagtttagactagtatagttagaattgagtgtacaataggatgaaatacgtagtaggaataggtagggttagtttagtgcttaggaacttgagcttgaattgaaccaggatacactagcacggtcattgaaactaatattgctgctgctgcaactgtagcgagtgtaatgtgtagttggttgtaggatatattataaggtttaattgtaaggtttaattgtaaggtttagttgtaaggtttagatgcaaggtttagatgtaaggtgtgtgcatgtatatcggtagagtatatttggtcgcatagatttagattttatatattcaaatcaatgttcaacttgctttcaatcaacttgctttcaatcaacattcaacgcatcattcacgccaatagtcattttagcagtaaacctcaaacccatcaaaatcatcagacccatcaaagtcaccaggcatcaaatcaaaattcctccatgaaagatggcagttttatatcccaccgagggtgtgctaatgttgaattttacgacatcgtaagagtttaaagtaacaacactttaatgtaatatgccagtaatatgccacaagttgtaatgtgatacaagtagcagtactggtagtttacttattgatggttataagatgattatttatgttgtatcataatgggctaaagttaattagttttcaccaagacctgtaagcttgaaccgtaataaatgcaaaccttacaagccatataaaatttacatttaacaatttatttagttgaaatttacatttacatacaatttatttagtgctataactattttggcatacattacgagctgtgattatctgtagactgcacgcatcctttaatgtgtattattttgtagtgcttagcaataactggtagatttctcgtaaaattgtacaataaaaagcattccagattgctgtctagattagctttttaattgtacactttaccactttgatgcatacatttggtttaatattctcttcaatttgcaatttaattaatgttcaatttagtatgtaattgtgtattgtaaagtgttgattaatacaagttcaagtgcaaaggttcaagtgtataaagcgaaagaaggtgcatttcatataccaacaggaacactgttatacctatagactttttcaaaagcaagtggtttcagtgcgagtgtgtacatgtggacatttaccatggagtgtgttggaatcattgatcctagtatatgcatttggcagtagttttttcgtcgtgacatcccccctatagtgttgtaagagtgtgatttagaattactaaatgtatagatggataatataccacatagttgtatgttagcgtatgttagcatggataggcatggatagttttagtttccgaattgtatttcctcttagtttttaatgttgacatagatttccaatttagcaagttccaattaagtaagtttaaattaagtaatttccaattaagtaatttgtaaagtagagcaacaacacggtaggttaatgttgatttttttcaatagtattggcagtgggtaggtttaacgggtggggtgtgtctttgtcgtatgggtcgagggttatctatgtttatacaagtttatataagtttaaaggtttagttttggttcactttaaggtacagcgtgtttattttaaggtatagtgtgtttattaaatgtttagtttgtttaaggtttcgttcattttaagatttagattgtgtaagttttacaggtaaaataagtggaatagtgtaagcaccagcataagaagtagtgtcgatttatatagtgcttccatttagtatgcaacttgtaatttgtagcttttgtacaatttgtaaattttgtacaatttgtaaaatgtagcatagtttttgaatctgcgtattaggtcaaccttggattgctatttatttatattgtaaggcgtattagttaattgtatagaatcgtgtatttagcatagtagtattagtagcattagtagcattagtagcattagtagcattagtagtattggtaagtagttccccaatctatcccaacggtatttattcggcagtagttgcattggcatctagtagcattagttgtactagcagtagttgcattggtaggagttgtactagtagttgtacgagtactagtagttagtagtaggtaattcccacgcatccgagtattgagagagcccagaatacatctatacttatcagcaataagagaataaattgcaacaatcagatgcaccaataatctgaaccatcagaaataataatcaagcataacaagtactagtttaagccttgtaaaaagtgtagctaagcagtaaacacttgactgtgataataaatgttggtataagcattctaaagttagtgtttaggtttaaggaggcttagaggtagggaggtagggaggtaggtagtaggtagacggtagagagacgggtgtttagtttaagtttgggttatgttaaaatttacactttatagatttgcacatagtatagttggatttgaacatagtatagtttgatttacacatagtatgatttacacatagtatagtttctaaaaaatacaaaatccaataaaaagcataaaatgtaagaaacccaaaaacaatacaaaatccttgaaaatgcacataaaaattgtaaaagcataaaacacaaaaacattcaaatgagaggtcaattgcacatgtagagttaagcgcatcgttttgttttaatttaagcatagcatatagtggcacacacttttgttgtaaaatgtaaaggcggtaatacaacaacacaataaattgatgtaatgcatcataaactagcaagtaaaataggtagataaaacagcatgtaaatagcgtgtaaggtagctcaagtaccatgtaagtagcccataacttagcaaataaattagcaagtaggagttttgtcgtttcttttatcacccatcccagaatttcaataatgcaaaataatggcactcgtatactataaaagccatctgtatcatgttatagcagcagcaaggacagtagtaaactgcaaaagtcgtctcagtcgagtttgtataaatgcgaatgtaacacgcgtttgttcaacaatattcagttgtctgataaatgaaatatcgtattagacttgtacaatttacgtgttttatagtatttgtgcaacatggatccgatcataaagagcaccctggactcttatattgaaacatgcgattacatatcgctggatacggtcgtcttgttgatgaccaacaaagactttaccctggatcggctgattagtgtctttgaggccaacgaagcgggaccgtctacgcacgatttcatacatcacgaagtgacaccgttcgaggtgagagcctacctcaggcgcaaacagtgcgtaaacgttagacgtggtctaatcacagacgacctgaaacggtggttcgatacggttcagagaatcagtggcagtataacgaatcgtaaagcgtttgaactggccgtgctgtttaaactgtttcccaagtactcgatggactacaacataccgcacatgctcagcgacctggcatcgtatacgagccttaaagagtttttagaatttatgcacgaagtggactcttgccgattgaccacgatcaatagtaagctactgcaaatctttgaaatgcaatacatcgatcaggtgattgctcacttgatgggcgacgaagactgcaactattacgtgaacctgaacgaggtgcgtgcctacaaggactcgttggtggcctttttgaagctcaccaaagccaaacgcaaaccgacacatgtgcgtgaaatggttagattgtcacacagcatggacaggagcatcgtaaacactgtactcttggtactgttcaagagcatcgaaaagccaggcttgaagaccaactttttcctaaagtgcatcttgttgtaggaatatggttgtaagaatatagttgtaaatctatacttgtattaataaatctataggtagttggggtatgtaaagtaagagtgtaaacctattcattgtttaccacacggtcattaactaatcatttccttgtatttaaatgtctatatgtatacttgtacttgttaatctagttttttgaataaatagtaaagataaatagtaaagatagatagtaatatatctgtgtagaataaatagcaactgtctgagcaaacatggacctcgaatatctactgaccaaactcaactgcatcaccaaagtggaagattccgactatggactagtggaccgattcaagctggcacaattgggctacctgttgttgattgcacgtcaagacggcggcaagtgtaatcatgtcgattttgaaagtcgcatgtttatccacgacacactgcacgtggtgcaactcggtgagatttgccaagaatgcatgagtctagcgatgcacgacaaattggtccgagtcaaactatcgaaaatgtacaagtcatcgtcggtgcccaacatgaagagtatcgagcgtcctccggtgataccgtttggcagtggctacagacgcagcaatgtctggaagaatagggtttagttttatactaatgtaaaaagtgttttatactaatgtaaaaagtgtacatttttccaactacactacaatactgttcttgtatcgagtaaatgcaacattttaaacaacacgtgtacgagtagttattttttagtattagcactagtagtagtagtgaatgcacaatttccaacaacttgatcttactacaaagtctagcatacaatgtttgaaggttactggttaccattgtgcaacctaaatgataacggtacggtgtttaatgaaagcaacaatgaagagtccgataatgaagcgtacaacaataacgttgatcaaggcattgaacgtgatgccagcacaccaccgttcgtgttgtctacacataaatttcacgaatgctacacgttcaaaccgagcgctcagtacgtgtacgatgtgtgcgatgccatagcggcagagtgttccgtcgagagcaccatcgatgcattcgaaacggacagaggtgacgacgaatggttctgtatagatttcctcaatgaacgcacaacaaacgatcccgtagatcctgcactattgcctcccgactctgacctgaatgcaatcggatggtttgtggtagactatcaaaacagacgaatccatacaaacgatcccatcttttatccggtactcgagcatgtctacttggaattttacgctctaaaatacattatatttgtggtactaaaaaatataccacgctttgtagttcacattgtagattaccatgccgacattaaacctgaagtgtcgctatccaataatggcattggttactgcaattctaaaacaacgacaacgacaacatcaacagcaacagcaacaccaacaacaccaacagcaacagcaacaccaacaacaccaacagcaaccaagattgctaccatagagactagaggtatctctgacatgtttctagtttggatttggaagggatcgtgtgatgaagcttaaagatttgttgtaagccaatttggaaaccaatttgtaaatcaatttaaaactattgtaaaaataaaagcattgtttacatgttcttaatacatttattaaattttatatacattagtatattttatatatattagtatattacattacatttgtttattaaataattaattaattaaagttgtacaattgtatcaagttgtatttttttattaatctacatattctacatctacatcatcatcaacatccacactgtcagtgtcctccaacaaaggccgagtatcaccaccgccaacacttccaacaccactaccaacaccactaccactacctcctcgtccccgtcctttgagcaaatctcccagattgaatttgacgtacacgaatcgaccaatgatgactagcactaccgcaaccactgccagtagaatgtatttcaggtacgagcccagtttggtcatgaacgtagagcccagaatgtagtgggccgcatcgcctgccgcatcaacgatcgtctctagcagtgtagaattggtgacacacttgaaagtcatattatcgggcagagtgtacgtattgacgtaggcgtacgatttctcatcggcattgggatcgaagccggtgcacggaacctttgccttgtccgcagtctgcaccagatcgcagggattcttcaaaggatgaccctctgacgaatggtagtagtgttccgacactttggcaaacagagtgtcgttctgtacgatggtctcgaacgtttccatggtgggtgtcacaccgcccagtacattggtcaaactctgccgttccatctctgcactgggatcgttgatggtgtgcaaaaggtacaagactggattgtccaaatgatcgtacttgactgcggaaatgtgcttcactcccgtcacggaggtgctgagacaagatctagtgggcaccttgaacgatgtagtcttgcctcccttgagcaccaccaagtagaagccgttgcgtgcaaccgtagcctctaccagcttttcatagtagggtactccgatggatatggccgcaaatataccgaccgccacaccacccactttgaccgtactccacagattgtcaacgatgccctttagcttggtcctggaggctttcggcaatcgttccaagtctgaggcgctagtcaccacaatgtccaagtcgggatgtatgattcgagcactctttaccgtctcttccatgttgcgtattctaatgtctggggtgtcgatgagcttgcgaaactttagctcatcggccaccgttatggcggtgggcttgttcagcttgctaaacatggacgccagctctcctcggcgcaatagcgattccacagtgtgtagctttacaccgttcacggccagttgccgatcgaccaggctatagttgagtgtgccaaacacatcgtcaaccgaacgtataccggtcttggcatttcggagcgtgctcacggtactggccggtatctcgtctactggctttagagcgcgtctaaagatggatgtaaaactcattgtggtagagcgttgtagagtttggattagttgatagtttgcactttataggttgtactttatatgttgtactttataggttgtactttatagttgatactttagtttggattagggcaaggtactgggggataagtaaaggatccgtattgggtctctaaaaaataagaataccagtggggtttagtttttatatttatttttatttaatattcaatattattaaacattagttttatttagtattctatattatttaacaatatttttatttagtatttagtatttaatattatagttgtattattatagagctgcaaaggtacaagtagcctacaaagatacaagtaaactacaaagatacaattaacctacaagttacactagacaaaatacaccaagactcactccaacctagacctctttgctgcactaccttcatcgtcctctgtagcatctacatcaagttgcatagcttcatacaaaccaccttcatctaaaccaccttcatccaagcaaccgtcatccaagcacaagtccttttctataccctcttcctcagtttcatcaacctcgtccatttctgtaggttcaggattctcttgattttcatcaatatctggattctctaaattctcttgattttcatcaatatctgggttttcttgattctctacaaaattacaatcctcctcctccatacactcttctttaacatcatactcaacctcctctttaacttcatccttaactttagcctcaacacactcctcataatttaccttcacctctacaccctcaacctcttcatcctcatctatcgactttacattacaatccgaaaaggacacgtccgaatcgttggcctccactttggcattcttaaagtcttcaaacacctcaccctcatccattagattgttcatcaactctttcatagccttttcattgtccatattgagttttgtaagcgggccactacatctgccgataaactctttggtctctgtatagtggcaaaagtcattggacatgggacacttggcattgtacacgtccaccacaaactcggtactagtgccaccaaacacatcgcacaactctttaaacattctccgttcacgattggtggtgattgggaaaatgttgctagtgctgctcttgccgcccatgttgctattgctggccggtatggagccgcgctgtggtatcgcacgtttgggcttgatcatgttggccagcactcgttgtggaaactctccgctcacagcgtgcaacggcaacttgatggtagagttggtgggattgttgagattgcgattcagtagaaacatgacggccacaaagttgtacattagtatgtactctggtttactgtgatccacgcacagtgaattggtatagtagcaatacaaaaagttggtcagattgtcagtcatctctactgccgagatttgcttcttttgatacagctccagcatgactctacagttggccacaaacactatgcgcgtaacatgagggcatccgttcaactgttccagctgcgatagcacaatctttggtccgcccaccttaaagtaaaactctacgatattcttgtacagaatggcatagcctacgcaatccttgactgcggccaacactgcatccacattggccacactgtccaacgacactcggtaccagttgaacgtctttggtgcgtacagccacttgatgcaaatggacggagtcaccggattcatagtgcccttgttgaacatttgcgactctttgacatccttgagccgcttcacgttcagtgcagtttgaatcttttgcgattgaatcatgatactatagtgtaggccaatgggtgtcttgtcgataccctccatcatgggattctttgaagtgtacaacagatacaattggttcttggtcaaattctttagattgatccagtcctcgtaaaactgatcgtagagtgcaatctcagccttgatcatttccttttccaactctaccgggtctagcttcttgtagagactgctgtgtacactgctactgcaagtggtactgtctgcggcaaactcatcgtccagcttgcgtttgaccgcctcctttttgatgttgtactcggcggccctctttagtcgcaaacggttcgcttcacgctcaatgcaaaccttgcgcgtaatcagcttccacacggtgacgaatcgtgcaatgtttagattgtctccagcctcggaatcgactcgattcggtggtcccgtaatgtcagtcaccagtgtcgattcagacttgcccatgctattgatgcacttgagggtgcgtctaaaggtggccatctgacgcttcttggtaaacagactgctatcgtcaccgtcaaaggtaaagtcatactcggaccgatcatagttgcaccacttggagacaaactcttccgaattgatcagtatcagtctgagaatgaatcgcaccgaatctggattgtacttgtacacgtccatcagagaggtttcggtaaagtttttcactgcaatcttgtcacccatatagagatcgcccatcatcagtgtggccggcgacagagcgtgcaacagcgaaaactgagtctggccctcgcgttccaacactttgctggaatcaatcttgtcgtcaaaggccgacttgagagcctgctcgtcagacgtcctcgtcagattgtacttgtacagttcaatgtgccgggcggtaccctttgacttggagtgcaccacttcgagaatctcatcgtcacactttagatagtccgaacccctcaggcaattgtcgacattcttacagttgaatgccaacaccatttctatgaaatcgtgcacctcattcctcatgatgctacagcccaagtgcatcagagtgtcaatctttgccagcagattgccacggtgcaccttggtgaggattcggtaaaacttggagtgctgattgaaccacttgtcgtgcgtgtagagcaagtgcctaaactgttgacccagcgcatagcgtggcttgtaaaacagattgtgccgatagccatagttccaggacatgctgcgcatctcggtgatggccatcttcattaggttgcgattcatagagttttcatacttgaggtaattgattgagatgtcgtctccgtcctgatcagcgtgcaggccgtccaatacaaacggattcaagtgaatacagggatcggtgtcgtgatgaaacatttcacacacatagatgcacgtatcgttgatgctcgggtcacgattgataatcaccaaattggtggccagatccaggttgtcgtaaatgtctcgcggaatcgaaattgaattgggtcccagctcattgtccaccaccatcgtcatacgggctccgttgtgtctgtggcccagcaggtaggatcgtacataggaccgtttgcccgattgtagaatactaaagttgctgcacttgaaatcgttttgcagaaactttttcagagtcctatcaatgtacttgtgaatcaaagtcttgacatcgtcgcacgaaaactcattctcctcggacggcttgacgagcttgatcttgtccggcatgggagtgtccgtctcgtaggcgtgctccatttgaaaactcaactcgatgatggatcggaaaaagctaaagtttttgatcgagtacatcttgggcaggggaaagatgaagcacttgcccagtactcgtacaccaaacgcattgctgtactcgtgcgatgccacacagcactcggcgtccgccttgtctggatcctcgtcctccagaggttcggtcaacgagtctagtgcatccttggtcagagtcactccgtgttcgatgcacattttgcagtcttgcaatccaactggtcgcaccttcttttgatcggtacgcttcagcttgaacaatcgatacagatccttgacgtctacaatcagcgtattgcactcgtccacgggctctatagagtagatttgcgcagtactccagatgggtttagagttggtggatacaatctccattttagagagagatgttttttagattagagaggtttatttataaatgcaggataggtacagctgcagtcagagagaaccgtctactttgagaacacaataaagactgtaccggtgacaaatggtgttggccaatttatacacacttgtgcgcatttaataaaacattgcataaactctgcactaggccacgtgcacatttgcacaatgcccgataggcactctgacagtgatcgacatgatttacttggattttaaagatttacaaaaactacaattgcccgacaatgcgtggaccgaagagttgatcgatcagcgcccctgtttcgtactgcgcaatccagtctattgtcgagtgttttggatgcacctgtggcggactcgactcgtggactcgttccggaaacagcaaaactttgatcgaatcgaaaacgtggacctggatcggatggtggtcatcgatgccgagactggggctctactctcggcaccggcatcggtcaacagtctagagacgtttgaacggctcctcaaaaaggacacgtactatgcgtccaatgtactcttgaccggtgtgagcactacactcatcacggtggtctatgtgattgtggtgattgtggtggttgcgatcgcttgctacactagcctatcaaagaaaccaccaaagagtcgttggtacgatatgctactcttgttgtagtataaactagcttaaactatgtacttgactttgaatacaacaacaataggctattgtctctattccatcacacacaatagtagatttgggagaaaccgctaatactaatcatggacggtcagacttcgtgcatttccgagtttaacctcgaagagcccagcagtagatttaccctgtttcccatcaggtatcatgacatttgggaaatgtacaaaaaggctcaggcctccttttggacggtcgaagaggtcgatctgtccaaggacctgtacgattgggagactcgtttgactgaaactgagcgagagtttatatcgcacattttggccttctttgccggctccgatggaatcgtcaacgacaatctgttgacacgattctctcaagagttgaccattccagaggtgtcgtgcttttacggattccaaatcatgattgagaacgtgcactcggaaatgtactctacactgattgacatgtacattcgcgatccgcaacgtaaacacatgctctttaacgcaatcgacacggtgccgtctatacgtaaaaaggctcaatgggtgattcggtggatcgatgacgacaagtcttcgtacgccgacagactggtggcattcgccgccgtagagggcatcttcttttcgggtagttttgcggccatcttttggctcaagaagcgcggactcatgcccggactgacgcacagtaacgagtttatatctcgagacgagggcctacactgtgactttgccattctactgtttcgcaactatctgcgtcccgagtgcagatccagcgatgaaaaggtcatcaacattgtaaccgatgccgtgaggatagaacaagagtttctaaccgaatccctaccggtcagcatgattggcatgaactgcaagctaatgtgcgagtacatagagtttgtggcagatcgtctactgtacgagttgattggccgcaagatttacaacgccaagaatccctttgatttcatgaccagcatatcactagagggtaagaccaactttttcgagaagaaggtcagcgagtacaaacgctacggtgtcggtgtcaatttggaggataatgtgtttaagattagtgaggatttttagagagatgtgttgacggtggtgttgatggtggtggtagtgttagcggtgttggtagtgttagtattgatggtggtggttgtggtatagaaagatgtactagttttaaatgtagaatatatgtatagagtctacttgactgtatggatttggttgtatagaattgtataaaattatatagaattgtaatttagtatagtttagagtttagttttttagtacgagttttagcacaagtttcaatacaagttttagtacaagttttagcatagtatactctgtattttttgatacaataaatattcatatgtttaaaaaataaaacttttgttttttaatcaaacatttatttatacatacatatattttttatactcctacatttaaaagtatagcaacttgcaagtaatatcaaaactcctaaagttaacattatagcaacgcacaacattattcaaacatgtacaagtaatatcaaaactcctacagttaacattatagcaacacacaacattatccaaactatacaagtaatatcaaaaactcctacattcaacattatagcaaatcacacatctaacacaagtcaacgttagagtcaaggctcctactaaaggattcgacatcgtttcggatgctttcaatttgactcttaaactctgcactacaatctatcgtcttgttgaacgagtccaaatcgagcactcctcccgacactcgtacaatctctcgagccaatttcagagcacgatcaatgtagtctacgatgcgttcaatgtcacactctttgacaccacgggtcgtcaccgcaggagtaccgagtctgatgccgcttggtctgagagcgctcttgtctccgggtactgtgtttttgttgcaagcgattctgcacagttcgaggatgcgctctgccggtgctcctgcgagtcccacactgcgcaaatccactagaatcagatgcacatcggtaccgccagtggtgacggtgtagcctcgtgaaacgagtccctctgccaacaactgtgcatttcgcaccactcgtctttggtagagtgcaaactctagagtggtggcctggtgcattgcggtggcgatcgctgcaatcgtgtgattgtgcggtccaccttgcaggccaggaaacacggctcgttcaatttcctgctctagtgatttgcggtaaaagatgactccggctcgaggacctctgagagtcttgtgcgttgtagtggtcacaatgtcacaatactcaaaggggccaggaatgactttgcccgcaatcaagcccgcaatgtgtgcaatatcggccatcagcaaggagccggctgcatcggcaatctctcggaatcgtctatagtccaagcgccgaggatagcaactggtgccggctatgattagcctaggtttgaatagattggcactctcggcaagtttggcatagtcgacgagtccagtctgaggatccaccttgtacggcatgctttcgaaaaagagtgatgtagcggacacgttgcggaatccgtgcgtcaggtggcctccgtcgggcagatcgagtcccatgattctaccgtgcggtttaacgattccagtgtacacggcaaagttggccatcgagcccgagtacggttgtacacacactccccattcggactcgttcaaattgaacgctctgagacatcgctgctgtgctagcagttcgatgcgatcgataaactcgttaccaccatagtatcgctttccgggcctaccctccgagtacttgttgatgagacacgaactcatgcattctcgcaccggtagagtggtaaagttttccgatgcgatcaactctaagcctgcccgttgccgatcggcctcttgctctacgagcgcatacagctcgggatcggtttcgtagagattcattactggtattgtttggagtaacgagtctacttgacgagcccctttaacgagtccctttaacgagtctatttgacgagtctaaaaaactagaacatgaaagacaaactctgagagcaacttgacgagtctatttaacgagtctaaaaaactagaactcgaaagacaaactcgggcaataacgattccctttaaagagtctaaaaactagaacatgaaagacaaactcggacaacaacgattccatttgacgagtctaaaaaactaaaactaccaagtcaaagatgcactctaacgagtccatttaacgagtctaaaaaactagaatcataaagtcaaactctagcatcaaagagtcctccaagtaacgagtctaaaaaactagaatcacaaagtcaaactcggacattaacgattcactctaacgagtctaaaaaactcaaactctaaagacaaacaccatcatcaaagagtcacactaccgagtccaaataacgagtccaaatacagactccaaacaacgagtctaaaaaactagaattatcaagtcaaacaccatcatcaaagagtcacactaccgagtccaaataccgagtccaaataccgagtccaaataccgagtctaaaaaactcaaactccaaagacaaactctgtcactaacgattccaaacaacgagtctaaaaaactcaaactcaatagccaaactctacctccacctctaagagccgattccaaacaacgagtctaaaaaactcaaactccaaagccaaactccacctctatcatcaaagagctaaaatgcacaatttcaaacaaaacttgcacaaaagagtcccgagtccatgcataaccttgagagactcggtctaaaaaactagaacgatttccatagaaaacgccttttcaaccttttcaaagctgaaacattttgctcgtttctaagagagtcgacaccgatataacaccaatagcgtattagtgttaatattgagcggatttgttcacttttcgcattctgactttagttgtgcgcaagtttgcacgccatagtgtaaatacggtattgtggtaaactagacgtcgactttagcagtcttgcaataaatcatggccggtgttcgttcactttttaccgtgccctccaactgcactacggaccttgctcgcagtggtgtgagcaaatccttcaacatcctcatcgagggtaatattgcttgtggcaaatcggccctcttgaatcactttaaaaacttggactctttcaccgccatagaggagccgttgcatcaatggacaaactttaaagggtataacctgttgcacggcatgggactcgatccagtcaaatggtttgcggcctttcaaacgtatatatgcactacaatgtttgaggctcacactcgaccggtgcggactcctttcaagattatggagcgctccttgctcagtgttcaaaattgctttatagatgcctttgcatcatcgatcatggccaagagtgatcccaccgatgcagactcgatggcactcttgaatgcggatgtgctcaagagtctgtgtgaagtgttgatagacagtgtgcggatcgatctcattgtgtacatgcgcaccgatccctcggttgcaatggagcgcacgattcgccgaggtcgcatggaagagtcccacatagagttgccctacttggagaagttgcacgagttgcacgaagactggctcattcatggcaagaaaccgatcccggcaccagtgttggtggtggatgcaaactcggaatccatcaagggtacgattcgcatcattgaaggctttgtcaagagctatagctcgcaagagtacgccaaggacactgcccaagagtatgccaggtttgctagggacgctagagatgtgtatgccaagatttgtagagaggatagggaatctgtgtgatttaaaagtgtgctctaaaaattgcaatctatacatttaaccgtgtgctttatcccaacatgtattacaagtcttaataaagaatatttacaccaataatcgtctattttttttgattatgtaggcgagcgtcctttgttagtctcttttcctctctctcttgcgtgtctttactcatttgcatctttagctctatacatttacaagtatgaagggtgccaacattttagcactggcactcttttggtatggtgcgggtgcatttgataaatacaatacactacccgatcgtagaaactatgattttagctacctctctgactttagagttaatcctaaacatgcaccaaccatgcgtctagagaatgaacgctatgacaatctatacgatgacaactcgttcaatacaagagttaacggcaacaagcgcgttcatgctacagttagaccggttcgtaaacatttgcctacattacccagacttgttcctacctccaatccaacctatgccgatcatgaatctgatcttgctgaaattcacgcatacaatagacagaatccattcaatgcggtagatcaagatcagtttcagattcccgatgagtacattgacgaatacccacaacaacaacaggctcggcaaatgaatccgttcgatagggttgatgaaatacccgagtcgaatgaagattccgagatggatgccatgtctagattcaatccaatgaacccgttcaatgtggccgattccgacaatgaacaacctgagagtattcgcaaacgatacaacaccaaagacgagtccaaattcattacgcccgaggaattggagaaactcaaattcttgggctatctgcaagactttatggtaggcgcgcatcttaggttgactgatggtaaactgtcactagaggagcctgccatgcaaccggtagtcggtgcactagaacgattccaatcgtacgcaaacataccaatcaccggtgacatggatccgcacaccaagacaaagatgaacaccaaacggtgtgcgatgccagacatttcacccaagcgcgcaaaacgatacacactccacgacacatggaagaatccgataacttggagtgttttggccaactcttcgaatattgaaaatataaacgttatccgtaccgatgttgacagaatgctcaaacggtggaagcgagaggctcccgccttggagtttgtagaggtcgcccccggttccaattctaccattacactgggcttttatcatggcgatcacggagacggtacacgattcgatggcaacggatggttcttggcacacgccttctatccgggacccggcagaggtggtcagattcacattgacgccgaagagccatgggtcttttcgaataacgctgaggagcgcaaacccgaggattcggccgacttccaatcgatagcgttgcacgaactcggtcatgcattgggtgtgggtcacagtgatgttcacgatgccgtaatgtatccatactatggtggtgtcaagcgtgaactcaaagaggatgacattgcggcaatcaaagccttgtacggcaacagaaatggtactcacaccaatcccagtgacaaacgagaaaaggaatcgtacaaagaggctgctgcagcaccggtaacggaaccgacaccagtgacaaggccaccaccgacaccagtaacaacacaaccaccaccgccaccacagcgacccaagacggaaacgtacaaatccaaacttggcaatccctacatttgtgatttgcccaagtatgacagtgtggccaacatgtttggtgaagtgtacgtgttcaagggaccgtttgtttggcgtatgggctcgtttaatcccaagactatatcagtctatccaatcaacaaagtgtaccatttgccagactttgaaaagctagacgccatctacattcgcaaagatggtaaagtggccatgttcatcaatgatctaatgtacgtcttttcgggtaatgatgttgcacaagggtatccaaagaagctttccgacatgggcatcgaaggctcaaagattgacactgcctttagatggcacaacaagacgttcatactgagcggtgacaaatactggttgtttgatgaaaagaaggacaggattgcaacaaagacctacctcattgccaactatttccgcaacctacagacaccggtcgatgccgccatgtcctggctgaacggtaaagtgtacttcttcaaagacaggggcttctacgagtttgatgaatacaaaatgtcggtaaagaatgccgacccgtacgactctagcgtgttctgggccaactgtcctagagaccatccgcacatttgccagatgcaacacatgtacggacacttgacggcctcagactacaacacttcaatgaacgcagcaatggccgatggagcgtttgactactcgttgctgcgcatgattgacactgtcgacacgtttagatacactgtgattccagacaatgcaactcagccggaacgagcgtcgtacaagagactcgccaacggtcaagtggtggtggatgttgtaccagcgggtgagtgaggatgatgagattaaagtagaccaagattataagattataagaatagaataagattttaatgtagactgaatgtaatgtaaaatactcttaattaaaatgttttacaaaatactctaatgctcagtttgtataccaaagttgaataatgttgtagattataagatgctgttatagacttttgtattgtgtaccttgtagagtaccttgtaccttgtacttttgtagagtaccttgtagtgtaccgtgttttgtaaaagtttattaaataaagttttgttttttagtcaattaatgattctagttttttagacactatacctttaaatgcaaagagaatgcatccattcaactctacacatttctacatacacacacatgtctttaaagacaatacttttaaaatgtacacacacatgcatacagagagatggttataagtacctgcctctagcatcctccaactactctaaacgcctgctactagtctttagcaacaaatgtcaatttccatacaatgcatgtgcaaaacacaaaggttaaaacaaaggcccaatgtttaggaatgcacattgtcaaaggtaaagacactacacttgagactgtttgaaatgcacggttgactgaatggtgctcgggttgactgaatggtgctcgggttgactgaatggtactcgtgtgtcgagacttgatacctctgaggaccatcttacaaggggttactagttttagttttttaaacaacatgtaaatgatttgatgaaaaaaattaactcatttacaactctgtgttttggttctctttagcataccagaacttgtgaatcacttgtgaatcggacaactcagtgttttggttcttgtagctttagcataccaagtggacttgaaccatctctctacctaaaatattacaagtaaacttgaaccatctctctaccctaaaatattacaagtaaacttgaaccatctctctacccaaccaaacctacttgaatagtacaagtctataaaaaatcaaacaatttaaataccaaaaaaagaaacctttatttattcaacaatgatacatggtcaacttaatactacaactttatcctacaacttatacaattttattctacaatttagacactggtttacaatactcttaattctaaacaccatcactctacaccaccaactctgaaccctcaacactccttctcagcttttgcatcaatagcttcagacacctccttgaacagagtgttgaacggtcccaccttgactaggcgtactgcgtccatcagacggtcaagaaaggggcgcttcttttgtgcttcaaagttggcctgcaagttgtcaaacactgcattgagcagcttgctctcatccacctccttgacgtgatcgtactcggcagagctcatgaggtacgttagaatgttgcaaatcttttggttgacaaacaagtggttggatgatgaaaactggccatctgtacgctctgcgacagcctcctttgttggatacattttctcgtgcagagcatcaatgtaggtaacgtcaccgggatacttggtatcgttgcttgaaaacactgcatacaatttggtcagcatgtcttcatagctcaccggatcgtcacactctgtgaatatagattcgtgcaagttggccacaaactcttcggccagattctcatcggtcaccgcctccattacagtgtcgatggctttgatccacttttgatgtgactctaaaccttccatttcatcgttcataatgtttagaatgtgagccggtggaatggcaacatctatgggatcgccaatgcacatttgaacaccacgagtgccgcgttcagttacacgttcactgatggtgtcgtcctcttcaagggtcggaatctctatacgctcacaaatcagttgtgcgatgcgatcaccctttgacactacaaagtcgtcatcggaatggttaaagaggaccactccaatgtttccagtatagtcgcggtccacgacaccggctccgacgtcgattccgtacttggctgccagtttggatcgcggagcaatcctaccgtagcaaccttccgggatcagtacgccgaggtctgtgttgacgagcaccctcgaccgtttaggaatgacgacctcgtgagcgctgcacagatcgaatccggcagactcttcggtagagtggatcggcatcttggcgttcttgctcagtttacggtacttgaggactggggcagacattttaatgatttggattcagagcagacaagatgaagctaagagagctggatcacttgtgcaattgttctactaatgttgccccatttataccaccaataccgtattatcaataaatgtgtcatatagttgcgtaattaattacattttaattgaatgattaatgttgatcaatttaattaaatgacaatttccggtgtgtgctcttgatcagttgttctcagagctccacaacattataccatttcaatttgagatgaattcaaccatgcactgaaccaccaaatcccctagactcattgattttcaatattgattttcaatatagagccaatcaaagagtttacgagtccatttcattaacctgacccgattccatcaaagtgtagccataaacgattcactctagagtaaataggatttcaaacaaatggagacattaaccacgactctatgttttaaactcggaagagtaccagtactatcaagggtttaaaaacaagagtagatgtttgatttaaaaacaagagtagatggttgattaaaaaaacaagactaaacatttgcttaagataagagtaaatatttgattaaaaaacaagagtagatgtttgattaaaaaacaagaagaatcttttgatgaaaaaaatagaatcattacactctttattcaacatttatatttatacatatataactctgctatataaactctactctaaactctactctataaactctgatgaatacaaaacaaacatatagaactctaaataaccctaaatgtaaaatctaaacacaaggctaaacataaacctaattaccaacatcaacagtaaacatcctacaacaatatagacatgctatcatccgagtccaactgaaggctactgccactgctgctactaaccggttcaaactcatcgttgctcgtcttggcaatctttgatggtgacacttcattctcgatggcctcaaagtctatgggctcttcgagggctggatccgagtcctccacagactgagcatcttgttgtatgggcttgaatccaaacaggctaggttgtaccattgccttgtctggtctgatcaacgagtctttgaattgaaacagtacaaagtttcgtatgcgtttaggtttgacgagtgcacgctccctggccctgactcgttccaacagactgatggactggtcagattcagaatcggaacggtcaaatgaaaactcttccgagtacgattctatggtgctagatttgatcgtgtaatctgtactggttgatgtgacagattcagattccgagtctagggttgacttggaggaggcttctttcgagtttaatttagaggcttcgttagagtcattggacggctctttgctctcatcctttgaagtggctttatcctcagaggtggactcagagttgcactctgatttatcctcagaagattctttaatttccgagtgattcgactcttttgatgaagtgtgttttggctcgtctttgttggaatctttgtggtctttaaactctttagactcggtacctgttgatgcaatcgaatctactctatcacagccaatagaatctactctggactctgctttagaatctactctagcctctgctttagaatctactctagactccccctttgagtatcctttataatctctcttcgagtcccctctaacctcagtcatttgcaatttttgcaactgtttacctctctgcacctcgtcaacttgcatctcgcagccttcacgccaagacgtcaaatcgcccattccgaaactcttggcacccttcattagacgccactgtgatgtgggctctataaactcaaagcactgttcattgttcgagtatcgatccacacggttgccgtgttcgtagtagcgcgaacaccaagccaacgattccacccaacgctctacggtgcagttttctgcccaagtcaacttgggattgtccttgttggcggtgcgcttgtccatcaccttggagccaaagtgaatgcgtatcgagtgctgattcttggcatgaaagattaccttgcacacttcgtacagtacggtacgccagtgtttggcctttgacagggaatcgttggttatgctatcaaaggcgttcaacagtgtggcatcctgatgcctcatcatgtagcactgacaaatggccgaaaccatggacggtgttagcaacggttgagtgtaatcggtgcccatcattataacgattgccgaaaacacattcctaggcataccgcacacgttaaacttttgcagattcacgaatcgttcaccgccattgagcagcaggtacaggggagcctcatcgtcgtaccgaccgtatgcaatgtggtaaacgtcactgtcgttggtcacgagtatggtgggtttggtgggatcgcgatccagtatcatttgcatttcgctttcgcccacctccaactgtaccactcggaaccacgactcttcctcgagcatggccttgtagtactgaagcgctgcctgtgcgttaaactttagatttacggcacgcttctttgaagtgtcatgtttgcgcgtaggaggtaagccatcgaagtagattacaatttccgaaatctttacactcaatcggtacatcattgctttgagcagatccaacgcattgtttgctatagtgtgtgcatctacgcatccgttgatgacacccttgaagagggtcaaattgccatccacatgtacagtatactctaggctgggatcgggtgtgtcgtacgagtcgacaatgtactgcttgaaaacgttgttaaactttaggatacccatgatggttgttgggctctgtcagcctgtatactagataccaaaaagtaattggatttctacaactatacactagtttataagccagatagggtaaacactttatccactacacccacatacataatgttgcccatttcatccatggaatacagaccgaatgggtgaatctcaatcttgtagaatttcatacgatgaaaggttgcaatgtaggaatcgatgcatcgttccgtgtccaccagatgcacagtctctaccagattggacacactgggtgcactgggtgcactggggtgcggtataccactgcgtctgagcagaatcgtatagggcactcctcgatcaatgtgtatccatttgcgtgcatttagacgcacacaggatcttgtcatttcgtagacgcaatcgaaacacttgtccgatagcgtagaaaagaacgtggacaggtagcgagtggcatcgggtctagtctgagacatgccctccaggactgtgctaaagttgctgctctcaccggccgagtgctgaaacactgccagattggcatcgtcgtcggcgttgtgcatcatgcacgtatagtgattgatgcagcgctctgtaaacttttccacttgcataggcaccccagtcaggttgacgctcatcagactgttgtagggatcgtttttggaattgctgattgccggcaccttggacatgagcaccagattaaagcccggattcgagacggtcaccgattcggcccaaactatggagcacggaaacgcattcggtggacaccgagtgtacgtgcccagattgagtttggagcgaatcgttgtgggtctgagggtcagtagcgatttcgagtgctggtacagcgtgtcggcaatctgtcgcaattcatgcatttcattgtggtagtgatccaactgtacggcagcatagtatctaaacgtttgcacagtctcatcctcgagcagctcttcatcgtacgaccaagagatgcggtccgcgtcgaccactagatgatcctcaatgtcgtcgattatgagcggctgttcaatgtgtagaatgttgatgcgcaaatgctgcaaatcactgtccacaatcaccagatcgtgatccagagacgcgtacgtggatcgaatcgtgtacgggtactctaccatgagtatgcacggtttgtgcagaggttgtagagtgcccgcatcttgtacgtgttgattgtgtgtaaattggacaataccagcactggtagcttccagagtactagaatcggtacttttaaaactaccattgcttttagtactcttgacaatattggcactcttaacattgtcatcaacagtactctttgagtttccgagcatggcctttttagtgtacagtttgatggcctctgcaacggtactgggctctggcatttcagagttggtaatgggtttggtattgcgatagagttccgagatgaagctaccgttcattttgatgccaaactagtacccaatcctactactactactactactaggagtcctactactaatactactactagtaatcctactattagtaaattaaaatacaactcttgaaaactcctacactaaaaagatatagcctcctcccctcccactcaacgcctcttgcaaccgcagcccaactcttgctcgttttcgtttaccggtacactgcctcttgctcctgtgtccgattctgaagagtccgagtctacactgtactcgctgtcggtatcggtgctttcgattctcttcttaccgtcgctctcaatgtttttgtaatagtctagaatgattgacaaatcgtcctcttgatgatcgtaagccaacagtctaaaagtcaaaagttgcaatagctcaatgtttgaatcaccaataaattgattgaaatcggtgtgcgcaaactcatcaatcagattgtgtcgcatcatgcatcggtagacgaccctcaacattgcaatactgcacaatagcaatcgtaaactttatcgcatacaaggcacacacacaatagcctatgcaagatagagacacgttgaaaaactgaaattaccgtacaggtagtgtaaacatagtcacaataggctattggtgttatcaacttgtgcattgttatagtatgacgatggtttcggtcggttctaatacgggagtctttgtagttttgttgactgttttaaaggccatttgtgattcgtttattgtcatattcttgtacttttcaaatactagttctagtaattgtcccactgtaaattgtgactcgaccactggtactctggcagctagataggtaggcagtgctcttgtttttgggaatcatgtttgcaaacattcaactgaaccagcaacagaattgcgtagtgattgacaatgtaccgtacgaggtcaatggcgacttggagtttttctacaatggagagccctacgtcgtctacctcaacactctgcctctgcgcaaacacaacaactttcaagtgtccgatgtgtacacggaaacgttttcaatcatgcgcaagagtatggccctggagctggctcagtgttttgccaacctggtgcccatcgtcaacattggcctaccggtgaccaagacgtgcaaggctgccctagaggacattatgaaccacttgaacgcaatggtcaattccaacaacgatcccaacaatgccatcgatcaaaactcgtacgcgcagatacaatcgctgatgaagacggtcgccggactcatgaacaaactgaccaactctcagctcgtaacctacctgacgtatggcaacgtgcagagcctgcgtatgacggatgagtacagcaacatttcacagaaactcaccgccatccgacagtacattgtgtgtgccatcacgttcaagccagagtttgtcaatcatcgcagtctgagtctaatgtttgacgtgttcctaaacattgtgggcactctgtgtctgctgcactcgcacacctttgtcgagtaccgcaatgtgcaggatttgataatacacgaaatcggcatcgccatcgagagtctcatctacgaccgatgctccaaggtgctgttcattgacggtgccaatcaggtggccagcggcatgtacaacgatctcaagattaaatatcccgaactgaagagcatcaattctgaaaacgatttggccaaaatcaaacacttggaggcggcattcaacgaggagaatgccaagtacaatgtcaacctgtttccgtacatgctcttttacaacatgtccgatgcggtcaggatccgtcagaatcttagatgcatccatgagatgcgtaaaaatgtagcaaacgatgttgagcaatttgaaaagtttcatcagtttgtcgtcgagtgttataataatctaattgaacccctaaacggcaagcactatgcaacctacacctttgactctatgcaaaagattttcacacatgccatctttgagcaagtcaatccgggtagtctaatgtagtttgtaagacattcatgtactcttgaataatgtaaattttaggtttttctttttttaaccacacctctaatacgctattggagttggctctttaacattcaatgatttcatgttcctacagtggtattgttgtacaatagatgatgcgcactcacaaaactccatcgggcatctttaaggttgaaatcatgaaagtggactcgttggacaccgacactgaaactgagagcacaatgagcaccaccagtacagaaactctgaaatcaaagcccgcagatgccccggtcgcaaaggactcggactctgaatcggatccatcctacgagtccgatgatggtactctgaccgatggctcggatgcgtcctctgtgattgatgtcaaacccaaagaggatccgagtccaccgaggcgatggtggagacggggagtcacccagatcgaaatggagcccgtccgcaataatagtacaacgattccgatcgacgagtctgccagtagtctgtgctcaccgaaatcgcccgagtgcatggctctgcgcaaagtgtacgcaaagattctaattgtggtatttggctcgatcacaatcatggcactcgcaacgattcggtccttccaaacatcggatatgggcgacgatgtactcattcaaaacgttaccgatctcataaaggagagtatcaaaaatggtgtttgaaaaaactagcatcgaaaagtgcgttattgtactagattagacggtagtataaatacaataacttatggcggttaattttatttgcagtttaacagttgagcaggtcactttgctgtgatataagcatggcttcgtccgcgtcctctcacatgtcctttaatatcatcgagtatgggactcctcaaatcaagatggatttgcctcgtttgaagaatccccgtacctcggccgagaacccctacggtaccgagccgcataagccgtttttcgattaccaagagctgatggctcgaaaggttgccgaggtgggtgtcgatacggatgtcgaactcgccgacaccgacaacaccgatatcgagaggcagcgcaatcgtgccaagcgagcctctttggaatcggacagcgatgccgactcggactattcgggcatcaaggtggacggggatcaactcttgcgcaaggccgcaaagtgtgtcaccgaacacaatcgtaaacgtggcatcctggacgccaccgactccgagtccgaggccaagcgtaggcgtcaggttgacgatgagatggaaaactttaagttcttgaacgagcacgttttcaacaagcttgacaacatcaccaagaaggctcaggcggagagtagtcaggaggagccctctgttccggttaggcgcagtcgtccgcagactccgcaccacaagagaaaacccaaggtgcagagtaggcgtgacgattctcaggatgccagcgatgaagacgacgagtgcaacaatcgtgagttgtctagaaatagttttaaccgtagtgtgaatagtggtagaggtagtggaggcaaaggtagtagagctagcgaggccaatagtagatctagtagcagggttagtagcagggctagtagcagggccaatagtagatctagcagtagggctagtagccgaggtaatagatcggacgatgaggctgaggaggaggacgatgaggttaacaatgagggtaatggggagaatgccaatactgaggttaatgctaacgagtccaatgtttcggccaatgttgatggttctaatgtagatggttctaatgtaaatgatgccgattacgagtccaatactattgttgaaaatgttggtgtagagggtgatttcaacaaggagaatcttgctccttccggtaaagagtccaacattgaaacggtagcattgggctcggccaagtccaatattgatgtgtacaattttgatgaggatgacaatgccagtgtcaagagtggtactagtgcatctcagagtaggaaatcaaagaccaagtccactattgctgtaggcaagaatctcgatgatcggcttaaatcgttgcagttgaatttggagttgaccgatgccaataaggggacttctaccaaagggggctctttgttgaatgcaaatggcagtgctaaaaactcggttaagaatggtagtgctaaagggggctctgtaaaaggaggctcggtaaactctaaagtcaacaactccaactctaaaagtgtatccaaatctaaagccaacaactcgtcatctgaaaagaccattaaaccaaaggtttcaaaacctgcacctaatcctgtacctactaaaactcttgcatcaacctcccaatccaacaatcaaacatctaacaatcaaacctcttctcaatccaacaatcaaaactcccaatcttcacaatccaacgagtccacctccaacgattcctcatccaacaactcgtcatccaattctcaatcaactgtagtaaatgtaaacactcaatcaaaagacaatactcaatcaaacaacaatactcaatccaatgttcaatccaatgttcaatctaatgatcaaattaatactcaatctaatgatcaaattgatactcaatctaacacgcagcctaatactcaacctaatacgcaatcctcaaccgctcctaccaaacgtcccactctaatcaatcacgccaacaccaaagtctctgatcgtatgcatgaactcaaactcaaaatgaatccacccagacgcactgacgaggctacaatcttggccattgaacgtgccgctttgacttgtaagcagtgcaacaaaacctacaagactgcacgcaatctgtcaaagcacacgtgcaagcctaaaaagagtgcagcccccaaacgtggcaagaaacgtacaagttccgaatctagtgcatgctctgagccagagaacaagtctgaggcacccgaaaagaaaaggaagctgccgagtacaccgctgggtgtgccagtaccgttgactagtaacagtgccgacaagcaggccttgtacgatgagtttaaagtggtagagccgggctttaagcacatgcacaagttgaacgccatcgatacgcacaagcatccgatagagttgcacgaaacgtatgcttgcaaggttagcgaacttgcctatgcacagtatcacaatgagacgaattgcactgctgccgagtttaagcgtgaaacggcaaacgtgcgtcagagcctatccaaacagattgccagtattcaaaatcagctaaaggacaagtctatggacaaggagcttagcggcaagctaaagttgcgcataaagtttctgcgcgcatacaaacaaatgaagctggccgagtactcttacacgtgtcccaagttgaaaatgtttagcaaaaagatggagcgcatctttactggtaatcgtgtagactcgaagggttctctacccaacaagattaccaatgccgatgtgcagaatgcaatctcgtcaattggcaagatgcaagttgacgatggcgatttgacgtgcatagctagatctttggagaattacattaccctcatcacactgtctgtactggccacgatggtcaacaagagatcgtgccgagtcaccagagccaatatagcttcggtgcttgcactgcagtatgcaatgaaccacgacaaagagtcgtatccgatgccagagcacggcaccatcaagactccatccgatggtaaactgaatgtaatcatttgtcgcaatgtgttggatttgaacaatattacatcggtggaccaagtgatggatgtcttgatggacgagtttaatggggagttgaaaaacttgtgggtaaagtttctattctactttaagcccagcagtgactatttcaaagtcatcaaagagttttacatcaagtacataatggcatcgtatatggctctgtgtaagatggaggaaaagagggcctctggtaagcccagcaactttagacagtgcatggccattgtgattaacaattgtacatggttccccttcaaggactatgccaatcataccgatgtgaatctggaccgacaggccgatgacttgtttgagcagtgcgatgtaaagcgcagcactagcagtgccggtacgaaacgcaaagcaaatagagccaccaaagaggtgcccactaagaggcaacgttgcgatagcagcgacaatgagtctgttgccagtaggtcaccgagtccggtaaagcgtgcaccggtacagagttctctggtcaacaaggctctagccaacaaggctatggtaagtgcacctatggcaagtacgcctctggcaaacaagcccactacaccggctgtcaccaaaccaaagagagacgatatgatcgagggtggatactttccgatgagtcgagtcgttaaaattagaaggctcgaacagagacgtatggaggcgaatgcggcaaatagaggtagccttaactctaacactaactctaaccttaactcgaatcctaactctaactctaaccctactcccactaacaataccgattccaatactaacagtgctaacactactaacaatactactaacaacactaaccccactaacaataacactaacaatgctaacagtactaacaccactaaccctaccaacaacactcccaacccttctaacagtgctcccaaaaagcgtacaagtaatggttcgcgcaaatctagtgcatcgtcaaagattgaccctagcaggataaagtctcgagagttgattgagaatgatgattttagcagtgatgagaattagagttggtctttgatttggagttttgattcatacttggatgtaatttaaatcttgtagttgatcttgtatttagctttgtattcaatcttgtattcaatcttgcatttagccctgtattcaatcttgtatttagtcttgtattcaatcatgtatccctagagtataaattggtataagtttcaatgtatccttagaatatacatttcaatatatctttagaataaagtcaatgtaacctcctagagtataactttccatgtatccatagattataatcttcactgtatccctagagtataagcttcatttatccttagaatataagttgtattactagatataaaatgattaaaaataaataaaggtatattaaaaaatactctatatttttaaaatgtgtacagtgtaatattatagcatctagtatacacgtgtagtataccaagtgtagtgcaccaagtgtggtataccaagtctgtgatatataccaatgaatattaatcaaacttttgtatatactagtattaagtattcttttttagacactctacttggacatgtatacttaacactaacctaaattactacttgcattttaccacttgtataactcacaatctacaaaattataatctacaaacttacaatctaccaactagtacaaattatgactttaaatctaagactgagttgaaactctaaataaatgatgaaacctctaaagatggactctttgatttaacccttatccttgttgcatacactgaaccctaaatccaaatataacccctgattcttaaagctactcttaaacacacaacttggcgcctacctttaaatgcatagttttgtacacacgtgtacaatgtatgaaagaaaccaaaaggcacaaacctttgttgtctacacagagtacaacagtttaaacttggcacagattgtaaaccgtttacaggccaacgaactcgtgtatgtgtaatggaggttgtggtcttgaacttgaaccgagttgtaaatggagcatagagtttgcgcagtagagttttcatagagtaggtttgtgccttgtgtagatggtgttagtagtagtatactgtagtattatacttgatttgatattttttaaataatacaaaaaacaatacttaataaatattataataaaacaatacttaataaatattataataaaaaaaacaatacttgataaacaacatctacataacatacaataccttttactaacatgcaatacatttgatacaacttggtctatgagtattctttgaaactacatttacatttaggtacatttacaattacatcaacaactacatctaaaactccttttcaaaatccaaagccacactatccaacacttcaacatccgaatctgtgaggtctgaatcggttcctcctacacaaaccctatcaacgcctactgatatgtttgatgcaacacactcggtagacacttgttgcaattcctcaagcttgcaacgtttgctctctggctgagaatctgaatctgaactagaggccgagtcgaacattacaaactctgccgacttgaaattggcaccagtgccgtactcttcaggttgcgctgtagatgccgagtgttgctctggttcaggttctactgttgacgccaactctcgttccaattccaaatccattttattgacaatacctttaccactgacctttctcttggagccagcctttaaagactccttctgagctgtactctttacgtattgtaaaatgcactcgttaccttcgtcgtcgtagcacaccacctcgtcgggatcagtcttggccttttcgtccaaccgatcctgaggctcctctttgaacgtgcacggacactgtatggtgtcgtgcagctctcggcggctcttgctggtgaggccattaaagttgacattgtccttgatgtgtttgtagcaatctagcaacggtgaagtgtttgtctgcaaagagtctacatactccttgtacgtggttctgagcactcgtacgcatcggccctttgatacgcgaaaagcttcaggcgtcaccactggaaacgttaccgtcttgtacagataggccagcacagagtttaccgaaatgattctctgattcaaatcgtccgtggtgattttgtacttttcacacagattgggcacttcgggcaccttgtagtagtactcgtcgtttttgacgtgcgtgtacaccaaactgcacaagtcgttggtgtgcaatcgcttcagtcggaatccctctcggatacgagtcaggcccacgtagactgcattcatggtggtatcgtccaagtccagttccatgtcacacttgtccagagtcaatccctgagcgctatagtaggtgttggtaaagaatcgcaacgggtactggtagcgagcaccctgcgacgttagccacactcgtaaatcatcaatggtattgtaggcgtttactgcgatgcgttgcaagtgctccaaacgaccgctagagtttaccacctcaatgagcgtaggtgacactttacgcacaaactgtaccacgtcctcacacttggaagtctcgctgtacttgatgtacgagtagccctgtatgagtacgagtagcggtgcaaacttgtagttttgaggcaacgctaccgcttcaaaggagcctcccgctttacgtctacagtactcggcctttactatggtgcgaccctctttgacgctctccttgaaacatctatgtatccggtccttcatcttgcgatgagtggccgtcagaaacatggccgtctggcactcgttaatgtgaaagtgtctatacagcaaagagtagagtgtatacttttcatggaaatccatgcgtatattgtcgtgcttctcgtccaagtgcaactctatggtttgtatgattttcaagtagtcggcatcggtgatgcgcatctgtttggtcagcatcagatcgaacgaggccagctccttgagcagatgcatattgttcattttgtgatagaccgaggtgcggatggccttttgttgattggcatcgcccaccatcaaaatgttgagtttatactgcctactgagcatgtgcaggaatataatcattagcggttgcatgaccgtgtactcgtcaaacacaatgaggtacggtatcgcgaaatcgccatcgttgcacggcaccatcttgaatgtcttgagtaatttgagtagatcgtaaaatatggaacagatcgtctttgactggggtgcgttaaagatgcacttggcctggttgtacgagagtcccagagtgtgcataataaaattgcacgtggtgcgagcattaatgtttgtgtgcagagtggccgcatcgtctttgagcgcattgctataaactacaaacatgatgggtgtgagcaacgaacacgccatgacacccataattgtggatttgcccgtgcccgatctagagtttagtacaccgaaaaaggagtcttctatcgagtgaatcttgggcggtgtatacttgccgtctagactctctggtacgcaggatgccgtgtccaatctaaagctatcgctaatctgtttgtgtataatctgaaaggcaaccttttgactagagtttagacagtggtacgcggcattggtctttcggaggcatgcaatcgacatggagggagtcgcgttctcgtacggtggatagtcttcaaagaaggcgatcggtttgtttagaatgaatcctagaacgctgtctggcaaatcgttgactccgtttgtaatcatgcgacatccctttacgttacgctgaccgttgacgatgcacagtttggccacttgtacaaaattggcccgattgatgcgcgtgtcgggagtgttgattagagcctttaattgatctacatcgtcttgtgtaatgtcacgtttacgcaccgagtgcagtaaacgtacaatttcgataacgcgctgagaccggcttagtgacgcattcatggctgtataccactagtgtatataaatatcgaagtatttaaaatttcatttagtacaatacggtattgcaactataacggtattgtctaacgtagaattgtagcatcaagtaaactagtactaccaactttgtattcatcatgatgaagacaaacattgaatctgcactcaaggctcctcagaagaggccagccagtgccatgatgggcaacaacgtgatgcccagtgcgagatctgtagatttgcaaagtgtcatgggagactcggccaaggttgatgagagcctctgggactcgtcaaatgcggtccctgcggcctctgccgaaactgtagattttgccaaaaacattaaactcatcgagccaccgccgcacgtgaagcgcatacccaagtttgtacaattggaagatttcaaaaaggccctggtagagtttatcaaggaggagggctcgtttgaattgaacgatcccaatcacgagactctgcatcagttggatgtggagcatttgtttaccgacgagggcaaaaaggccaccaaggtactgtaccatgccgtagagtatgtctacaagaatctgtacgaagacttgattacgaatacgggtgatttaaagtttatcgaatggtgtctgcactttttatcaatctacacggcagacgccattctcaagctaaaagagtttataacgattgcgaccagcagctgtggggactcggtacgcgtagacattaaacgtccctgcctgggtaggtttggtaaaaagtccaaagtcagcaaggatcagatggccgagatgaatcgcaaagaacgcgtagaggcttggctcaaaatgatcaacgatgcgtttggtacactggacgagacgtgcggcaaggtgtcgtgtgtcagtgaggagaatctcaagtttgtatcgatgcagtgtaaaatgtccaaatttgacatttccaacgttagcgtcatgggggctcagttcaagtttggtaaacgcttgttcatctttaccaagatgcacgatgcggcatcggcgcagattctaacactggagggtgatgccagggacatgattgtgtccagtgtaaacaaccaagtgaccggtgtagatttgcgtctatcggacgtggtcaagatttgtgcctacaagaaggttcaaacactacaggcctatcagcgtgccaagaatggcttcatggtaaacgatggagttcgcaagtctggaaatgtggccattctgattgattccataatgttgtcgcctcagttgtcgtctcagtatggagatcaaaacataatcaaactgtatccgctacgagtgcaaaaggtggattgcagcatgtttgactttacctttgacgaggacgatgatgatgaataggatggagggtttttgtattcagagttgtatttgagtgtttttgtatggtattgtattagagtagttgaatttgtatgtattaagatttgtagagttgttgataaaataagagtttaaaaaaatatgtattctgtaatatgtattctataacattagtattacttgaataaatgtagttttttgatacaatagtatgtctttatataatttttaactataattttaaatataattttaaatacaagtttaaatgtaatttttaaatatacttctaaatgtaatgtccatgtatggttatcaataaaactcaaaactctaacattattttttaatctctacaaacgtgaacctctataacaaacatccatctctaccttaaacaatccaacccactcatcctatccactcagcctatccactctcctctaccttaaacaatccaacccacctaaactagcctacaacaaatgtgccaccaactggtccctagtcttgatgtagtagtctgcatagattcggtactcgagctccgactctattgaactcttgtcgacattggtgaatctgtaaaagtctacatatagcgcagcttgatcatcattagtcttggtggtggtagtagtagtgttagcatcagcatcaacctccaagagtgcaccggcatcctcaatgtgcggtattgcaaagggtagtctaccggccagttttgtcttgagcgattcatcgaatcgtagcatgtcttcgtcaaagtttaacaagcacactagacgtttacccagaggcgatgtgtgcaccgaggtcacatagagtgcctttagcacagtcataaactcgtcgtctctctcagagggcggtgtcgaatggtacagtttgaccagttccaattccttgagcctaaagaaggttgcatagtagagtgtcacgtccggtgtgttgccgcgtatagactcgtaggcatacctcgcctgttccacatccaccggcagattgttgattcgattacagtcaaagagtacaaacttgacgagttcattggcagcggaaacttcatcaaattctgtacgtttgtactttttgcacaaaatgttaaacaggtacgatagatcacaactcttgcccattatagtttcccagagtcctttgagtacgagtgcagcatcgatatcgcccttggtacgagtcatggtcaattgaacgttggtggcatctttgatgttgtacggtgccagctgcagagccaactggagcacttcaaagttgccaaatctaaacgtcaactcgaccagtgtctgggcgtactccatcagggcacaatagtcgtcgctggatatcttgtccaactctgcatcgtgctcaccaaacgttacaacggtaccgtgcgtcgaaccgtgattcaacaccagatcgggtcgcgcctcttcatcggtggcggtggtgcgatcttcaaacactcggttctcgttgagcaagtgtatagtgtttttgttgactctaaaattcaaactcttgttgtcctcttgggaattgtacacttgtacactgtacgtgcccacatcgggaaaacactttacaatctgattcacggtataggcacacctatcgatcaccatggactcgggcgctcccttgacgatccttttgaaaatgtactcgcaatcggaccgggtgagtttgggtttgcactttagcaaggcgctgttgtagtctacgctcagaaagtacaaaaggctagagtagttgacgttgcgctcggtacgatgccctctgggcagattggtaccgatcgcacgcatcagtccgtaacagtagccgtgatctagctgctgagcatctgcattgtctaggaacgcgtccacgtagtctgaatcgtagctctcggtggcatcgtccaagatgcactcaaacttggagagagtgcgatcgtcaatcgatgcagtctgtcggtccagttgaatgcacttgtacagcacagccttgaacattacgaatcgtgcactggccgtgggcagggctctaacgccggccactgcagtgactagggacacgtttggattcagcgtcagatagggaccgtgcaacgattccggatcgtgcttttcatcaaacacatagggtaatctatagttgagcgcaatgtctgtacaagagtcggcataaaaggcaggtgaagtattcttgtttttgtaggagcacttttgaacagtgccaccctcgtccgagtccaaggttacgtttgcaaggcacgagtacagattgtacaattccaattcattcaaacgtataggagtctcttggtggaggttggtaatctcttggatcacggcactcgtatactttgccagattggatacttttagtgggtactctagagtggaggaggttgtatcgtgcaacgactcttttaagcgttgcaggatgcctactaggctggctctgctctgggccagtactcgcaccagtagccgattgagtgccagtgtcggtatggcatagtgcctagtcttgctcaatcggtacatgtcataattggtgggatgcacacccaccgatgagacgagttcattgtacctgactcgatgctcgtacgtgtgctgggaatactgggattggttgtgatgttgttgttgttgttgttgttgtagttccatttgatttgtataggtaactctatagagtaacgagtctacaaggttacaagcttagtgctagtttaatatcaaactaaatacaaagccgtgtcggtgctttgcattgctaaaaaaataaaacaaggttcggtgaggttgtctcaaaaataagtaaacagattctacttttgtataggtatttattaaagagttttagtattgttaaatatgtcaagtattgttaaactatgtcgtgggtaatctatctatccatctatcaaagagtctactgtcaaaaatacaaaaatgtttacagtgtaatacagtacaatataatctaaagtgtaagaaatcgaaatctaataaatctaaaggtaaatctaaagacaaatctaaaatgtaaatctaaagaccaaatctaaaatccataaatcaatccattacacgtgcactccttagccatcatcctcctccacctctacgcactctttccagtcttgcaaaacagcttccaatttgtctgctgcgtaaagtacataaacagagtcagtgccaacaggcagattatggcaatcttgtaaaacagtgtaagctcggcaaatatcaatataatgattgatatggccaccggtacaatcacgagcgtaggatagcaaaactgcgacagtattgtagttgtggtcacttccttggcgggagtttcgctgggcacctttgacgagctaggagtggctgacatgatgagttttctcttcttgtgtaaaactagacccttttcaactaggatgctatccatgaataaatgtatcaaaagtcgtacaatgcatgtgtctaaaaaatacaacgggtatactttattacaaaacacactatatacaattttcaacatttttagatacaatgtcacgaatctcatcacgatagtactcgggtatatccaacggctgatccatgtaggctcgttccaaaaactcggtaccgatggccagatgccgattcagttcacgaatgataatctttgcaccgagtccgtccagctccatctccgattccacctctcgttccagcttgtacgagtgcctgccgccctgacactgaatcatgtgtcgcacattgccatcggtgataaagtagtagccgattgcattcttggtgaccaccatcgattcggtgggctcggccagtttcatctctcgagacaccttgtagctgcacttgaggtactcgtccacattgtccttgtcctcttgcagtacaatcttggcatcgtactcaatgttgttattgtccccattgtacagagtcttgcgcacaatgaccggcaccgaactatcggaaaagtccaccattgtattgtagtaggtgcgatccatcatccgaatcggtgcgtgattcatgtccaaaaagtttctcgtagcatacagcgcagagagcaccgtctccagcgacagctctggatactccaatttgcgcttcatggtccactcaatctcttgcaccatgagcgagtgtgcatcctttgcagtcaaagtgtccgtagacactcggacgctagaatcgtcaccgacaatcgtaagaatcatattgttgcaataaaaacaaaggctagtacaaagactaatgcacacgaccaacgcgaatgcttgataaaacctgaatgaatttgttcagtttatatatgctccatttaaacacctactagtgattattactgcaatacttgttatgcgtttaatttcaatagactattaacggtatgcgtcaacgatactttacagaaacaacatgcagatgcaactatgaacgtgtggatatcgtttagtaccatttttgcgctatcggtggtgaacattgccattgagagtgccaaggctcgaaataggataaatttgtcaaaaaacaagtttgtctacaatccatctgagcgacatccgttgttgtagcatcatggattgcaagattttgtccggtgaagagttgaccaaagaggctcaactctttatcaaaaacatgccagagggtttcactctgacgaatcctatgcaattgtactatggccacaagattcaccggtacgcttggatctctacgccaccgttcaagtttgacgaaaagactatgactcgcaatcgcaacggtttgtttataaacctgctcaagtatgcgagatctctgtatgcaaaattaaacattaacgtggtgatttactacgagtctgatatgccgcctctgtttatgggtaatgataaatcaatcgaagcggtaatctctatgattccagcataccgtctgcgagcagtgacacatgcaacttggaaggataaggattgattggagggggtactcgtacaattaatgtagagtcaattagtatagctaatagatttagtttaacatttgtatcaattatggatttcaagattttataaagtgttttgatgaataaaaatccttgttttttagtaagtcaactctttgagttcaagtcttattttttacacaaaccaaaacttgaacgcaccaccagtgcacgctgcctcaatggagttttttaccattgcatcgctcgtactcatactggtgtgcgtgacctacctactagagtgtgcacgcaagagttttgaaaagtataacgatgaaacgaaaaagttttcatggggccgttataaattcaagattagcgaaatcgaggccaagcacacggaatctaataaagattctaatttacaacccagcaacactgtaacaaggtttaaaggcccctttcaaaacattaaatacaagaacccctctacagatcccgtaatcatagatccgggtcagacgaatctttacgagtgcactccgagtaaacctaaagaatgcaaattgtccgatgccacttcgtgcatgggctgtaagaatctgactgcacgatgcgtccacctaaaggaggacaccgactacacagacaccgaaaccggtcaagagtttaaactggccaagagcaagaccctcgacgacggttattgtctgagtgtgaaaaaggttgtagacttgtgcaatcccaatcacggcaaactggcactggtcttgtacaatagggacttggacgaggaggcctacaacgagcccgaggatgaaaatcaaatattctacaatctattgtgtgtctgtaccgagccgggctacgtgggcaatctgggtctgttgggttcgtgtgaggatccctttgtgtgcaacggtaaggttgtagacattaatgtacccctcaccgaaatggtttgcgagtgcggtgacaatttcgagtttatgcgcatcaacggactgccaacgtgtcagattaaatcgatagacaacatgacaccgaccaccgagcccatagtgcccggctctgtatccaaacagaggtaccacaaaacgatcgcagccaactacaccggtgagagtctaccgaatccgtgccgagtgtgtcccgtcactggcctagtggtggacggagccatcattgccggcaaggacggtagtgttcagtgtcagacgtactcgcaacactatggagtgcccatacgcagattcaaagacgaacgcctactggcaggcgatgagggccccgatgcgattttggccatttccaactacaccgtagacgtgtacggctacctagaggacaccacctatcccacgctgggtataaactttacccgagacgacaacaaagagtttttcgatacgctcaagattgacaaggacgagtacacgctactgattcgaccctatcatcaggtaaagtttccgggcaactttaagattaccgatcgcctgtacaaggtgcccaatctgaaactgtacgagtacacttggacgtacgatttcaaattgcagaatccggcccccgagtctagtggttttgtccagtacctggatccgtacacgttcaatctaatgtacgatatgctgtccatgtactatctgtggggtcggacgtcgtactatacagtcatgaatctgaaaccgtttgtcgtgctcaaaaaggtcaacggtctcagtgtgtactcgaacaataagaatctggcaaagattaacgacgaaactatgaagctccgattcctattctttagatttgacttttcaatggatcgatcgctagtcatgttgactgccgagaatcgatacgattgggacaagtatcacgcattgcgtataaaggagggtgaatgcggtggacgaatcgtacgcggtgaatgcatagatccatttggtgtgtagactgaaaattacttgaatgtttaaactctttgtttacttgaaatgttaatgttggtatttgtactagtagtagtaatattgcaccattaattctaataaataataatagtaatagcttattagtgttgtaaaactatagaatatagtagggcctttgcaaactttacgtgtctataggtaaatccagacattttattactcagctttaacttttaacggcatcatgtacaagcacattaaaccgatgcaaagcaagctgcatcagtccaacaaattgaatcagcattttataccgacacctagacctctgaccgactacaagtgtatatgcacagaggcgctggaaacgtttgccgtagcgcctgcgtccaaaaacattgcactgcacaacgccaccattctttgcattctgaatgcgtacaaacagtacgtgtgtagtcgcagaacctttctgtccagagaggagctgcgcgagttggatcggtgcattcaggcggttcagcacaactttaatcgtagcgtgtgtgtttcccatttggattttgaagcgtccgatgtgatgctttgcaatacgagcaatagccgagtccgactgcccattgtgcgtactccgaacaatgcacagtcggtgtgtcaggctgcggccacaatgtgcggtcaggagattctcaagtttgtaatgagccattccacacccaatgccataaaattggaaaaggcgcaacctgaggccagtgagaaaaagattgatctgaagcgcatagccgccaagaatgatggtggtggtggtgacaatggcaacattacagtgatcaatgtgcaacccaaactggtacaattgatgaagagtgccgaaggcgatattgccaagttgacggctttcggttagggagtgtgtttgagagatttaggttttggggttgtaggatagagttgattgttgtaggttgtagttgtaggatagagttagaggttgtctcctagagtgacgagtagagcaatgtgtgcgtggaggttactgtttgattatttgtgtaggagtttcttaaatgtaattcccaattaattttgtacttgggttaaagatttgtgtattttcaatttgtgtagattttaaattgatttatatagaatacctcaataaatacaagattcttgatttgtgttttttagcatctaaacaaaaaagaacatttattacacctctctgcgacttgcaagtctacagtagcatttattcgtgaccgtaaactctactttacaatcatataattaccatagctcgggtaattttacttggaacggctctttatgcaaacaacaaatattatgccaatttaaagcaacccatgaatggggcaccataattgtgtctataaaatgcacacaagacttgagggtaataaaccgaatgctgaatgcagattgtgtgtgcatgtttggggtttaaaatgaaatgtgaataatgctcggattaaatggttttaaaggattttgaaggatttaaaggtttttaaaatatgttgcagtagtataggataggagtggacgtagtaaagtggaagtagtagtaaagtgaaaagatgcatttacttttaaatgtttattttttaaataacaaaaaaaatactttattgtttaataatacaaactatgtagtagtgaacattaatgcttatatctaaagtgcagaataaacacaactctaaagtgcagaacaaaccttaacgctaacctaattctaaaatacaaatcaaatatgaacttgacatacatctcaaacctcaactctaaaacacaactcaaaacaaaacttaatacaaaacttaaaccatcaaaacaatccatctacatgtgaaaagtcagcatccaaatctttgtacgatcccttactaatcccagattcctctctgtcgatatcgtgttcaataatagaatcatgcacaatccttgaccttttcggatcacaatcaaagctcagtttgcgtttgcactttaaatttccaacagagtgccgtttgcgtttacgtggtgcatccaacaaatttaaaatctcttcatcatcacacaactcaccctcttccagttccgagtctacataggaacgtttgaccgtcttggatttggacttggacactgatttggttttagaccgtttagatgaggtgtgtctagttttggtctcagtgtatgtgtattcaaagtcctcctcctcttcatcagctggcacatcaacaggccacactgcctgaatctctggcaatctgcgattcagttttggtcgagtgattggattcagtttgttaaaatggttgttgtggttgttgtggttgttgtggttgttattgttactattgctactcttgttgtactttttataattcttaactttaaaagttgtaggataagtctgatttagagtgcaaggcttggtgtacaaattgttattattgttgtggttgcttttgttgttgttactattgtacgagtgcttaaaactcttgtagtgagacctattcttgttcttgtaaccttgatgcttattcttgcaattggctctgtatgtatccttgtactgttgtacactgtcctcattattgtcatcagcatcatcatcataatattgcgtgttgttgtattgattagttgcatgctcaacctttgaattgacccatttagaattaccataagccttattatcataacaatgttcagcattagaataaccagtagtggatcgtctgcgtttacgatgcaactcgtcattgaactcggcgtgatccttgtacgagcggtcatcgcaatcgtactcttgtttaccgtagccgtcctcagtgtggtactcgcgttcgacagagtgctccgaaacgacacccttggtggaatcgtaaaatggtgttttcattgactctttgtcattgtagcctctatggtttggtttggtggtacagtgctcatgtttggattcatacgagtggtgtctagagttagatttagatttagatttagaatgtgatttggatgcagaatgtggtttggatgtaggatgagttttagagtcagagtagcgtttagagtccgagtgtaaagagtccgagtgtttgtaatcatgatatttatactctgagtgtttggattcagaatgtttagaattagaggttttagaatatttagaatcagaatgtttatattcaggtttacaatccgagtactcggaatgcttagttttgtcacttgaactctttacacttgggctctttacacttgaactctttacactagaactctttacactagaactctttacacactttgaatgattctcgatactagcatcactctttggactctctacaacattttcataatccatacatttagaatcgacactacctttagaaatgctacactttgactcgctacctttagaatccatacccttggaatccttacaatcgacattctcaacattggcatcctcagtgtaatcaacctcagacaaattgaccaaatcatcatcctcagctagctcttgttccaatgcacactttaacatgtgcagtggagtgtctgaatctaggctatagtctaggctgattgattcagcgtcagattgtatcggctctattggcaatggtgtagaagtgttgcatggtggctctttcaaaacattttcattatcctcttcaatgggtttaatgatcgactgtggtctatcatacttgtaaggtctagcatatcggttattgttgttgttgttgtaaaacttggaattgtaattataaccattagtattgttattgttgttgttgtatctacgattgttgttatagggcgccttgtacggtgtaaaagcagatctgtttggtgctttgctaatggtatttttgtaggagttgtaattgttttgattttgattaaaagaatttggatgattgaatgaattgttaaagttgggggtgttgttgtagttattgttgtagttgttgttattatagctactgttgttatagctactattgttatagttgttgttatagttattattatagttgaaattgctattgtcattaaaaggtgcattattaggatagttggtgttgctgttgctgctgttgttgttaaatggacacggatagggattgttattgttgttataataattgtttgaattggaataaaggtttggataagtgttacagttttgatagtttggaaaagagttgttattgttgctattgtaattgattgaactaaagctgcaattgtaatcgttgcaagagcaaagagtcggttgcatgtagttgacattattaggatatccagaattgggaaaagagttgttaaaagagttgttaaaagaattaaaagaattgggattattaaaagaatttggattggtaaaattgttaaaagagtttgaatcaaaagagccaccattgcaattgaaaccagaattgttgggatggttaccatacctgtttccacttttaaaattgttaccattgttgtagctgtagttgttgtaattgtacgagctgccacctccattgccattgccattatagccacgataacacaatcctaaacctgaaccaactcggccaacaatcacactaggagtctcgatacccttttcattatacattccatcattgcacttttcaatattgtacttttcatcagtatcctcctttagtttatcagccagattggtggcctcatcgtccacagtctccacgtccacattgcactcgtcttctaggttcttactcctcagtacactgtcgccaatgtgcatgcattcgcccaagttgaatcgatgcagtatcgaatgaaacacatgtcccactcggcaatgaacgcatcgattgcggtaatgaatgtccacatcggggcacggatagttgttgaagcagcttccaaccagtgagactttgcacaggtacagcttgctggcattctccacaaaggtatcgtaccaagggtagccgttgctctgcaccagattctgagcatcgtagacgacaatcagatcgcacgacttgatcacattgtaaaagttgccatagttgcgattggtcatagccacctcgggatggttcatcgtaacggtggcatagtcctccatgcgctccacgagcatggtacacttgttgtacacgagcttggaaaccgaggctccggatgcaccgttgcagatgcgattgttcaaacacttggacactacggaaaagacaatcattgcgatcctgactcggtgacactcgtccgatgagtgcaccttgcacgtttccagtttggacatgctctttaggtgctcgttccaagtggcgagccattcagtcttgcgattcattgccgactcgtcttcggcatcgacaatccaagagactccgacctcgctcaatttagactttagcgtttcgtttagagtttgagggccgacgatgtagtcgattatgcgctctccctgataggtgggatacgctacaatggaacgagtcacattctccatcatcagttgcttgagttgccgcagcgattgaatcgactcgatttgacgatactcgaacgcattggctgcattgcaaattttattgatcctctccaactccacttcaagagtaatgtttacatcgtcgtcagaagaggaggaggaggatgaggaaattgtagaggattcagatatagaggccatggttgattcaaaagccaaaaattaaattgaagcagacttgttgtcttggggacttgcaccacaccactggtactgatagtggtcgtgcaccgtacttttaaagcttatctctactacattttatgttgaaatattaacaatacgctatgggcaatataaatagcacaagtttataagttgaacatcaaacgttgtacgaacgttctacagtatacatctatacatatactaataacaagttgaaaaatgtaccaatacacggacgttgacgatttggatctcgtttcgagcgaactccaaccgagcctaattgtgcgtcgtaaatttgaactggagcccaatcggtccgtgtatctgatcaatcggtactcgtgtgtaaagccactgaatcgcaactatggcgaatacgtacataatgttgtcgaatttagagactgcgacctagagtatggtcccgagtgcctgcctccggctctgcgcgaagtattctaccatgtcaatttcaagtatcgctcgtttaacgtactgcacccaaactcggacttgtacgcgctaatgtgcttctttgagacggtggttgtcgatttggaaaagtgcatcgctgccaacgatttgctgattgacgtgtcgcggatccttcaaacgcttctggtcaactctaaactcaactatacgatagacacaatgttcgggccggtgccgtggaacgatacgattttaccgattctatcgatgccgctaccggcagagtctctggttcgttacaagattgataggccaaagattagcctggggcaaactcttcccgaaatggatattgacaagatttacactcgcgactatttgatgagcgtaataaagacgtatacgacgggtggcgtcggcaccgatcgcatcagcgacgacactctgactagattcgtaaagcacactaaaaatatatcgccagctttgaacggtactgcgtgtgtgggcaagagtacaattctgcgcaatattacaagctgcgctcaaaagagcctgggaccagattttgacggtaccgtgcaggtgctcaaactgtctcagtacggtggctttaaggacaaggacattaacgatctcgtcggtatgcaatgcctgccagtgttgatgcacgcctgcgaagagtactctactagcgtcacggataggtgcgtctttaacaatataatctggaaactcatcatgtcactgtttgacgcgtcctctgatcaagaactgatggagggcgcctacaaggcattgcacacgctcaatctgaatctgctagagtttatgaaaaagtttcccatctttgtattggtcgactcgtcgatactcttgaatagaaaacgcatgtttaaccgaggcgttgacactctggagaagagcgaaaaggttaccggtgacttgtttcgttgcaagattgtaccgtatgtcaaggctcagaatgtgatttatggcacactggccacgctgtgtgactggccagtgattgatgtcggctacaagtttccattgaccgcagattggatgtctatactgacgaatacgttttgcaataaactcgttgaaaactacaaagtatcaaaagctctcgctctcgccgacaacataagccgggattttgattgtcgcggttcctacattgaagactcgtacaccagagactatggccaccgtccaatggtggacgagtccgaggagccgccagccaaacagtctagactggacgatggctctgccatgcacaagtacaatactcgcagcaagccctttcaagaggtgctcgtaaagagcgaggccaagagtgtcgagatcaaaagcaacagtagcaatcccggcaacggtgcatcaaagagcactcagactagcaccagcagtaccagcactgcagactcgcagagcagctgttcctcgagctcgaccgattccgaaatgaattttaccgaaacaaccaccgacactgaagactcggacacttcaatctcagaggacgagtccagcgtggccaccgttgtgcccaaagagtccaagacggatgtgcaaaacaagatgcgcaactcgagagtcgtttacaaatatagacactctgagtatccgattctatcctatttggcagcaaaggcgatgaaggttttcaagtaaattgtactcgtagaaatttgttatgtaaaagcaatattattgtaagcaccaaatgtacatgtttagtattatgtttgattgtttgcatgcactctatgtatttagcaactattcttaaacctcttgtaaccttttgaaatcaataaagtctagttttttaagcactctattgttgttgtaagttgaattgatgaatggaaataaatggtaaaaaagtacacaagtctttgattgctttaaaagtatcaatgtaccagtaccaacactaataccgtattggtactatatttggttgaaagtctaagaggcgccatcaaaatgaattgtgcattggtaatctcgggatgtctcatcggcgtcgtattgggctccatgtccatgcacgccattataaagttgctctttataatactgctcctgtggacgacatggactctggtgcagcagcacacaaacactctgagtgattggttttcgtcaaatgtaatgtctgtaatcttgactaagttgatgccaccggccaagaccaactcggtgaagccctttaaactatccacacccaagactcgaccagagagcccagacttgagcatgggaccaccgcccaaagattttgccttcaacacggccgtaccgttgaacgcaaagcccaagtctcgttccagatccaagtctaggggtgagagtacagagagtgaggatatgttgttgtagaggtttttgaggtttactttagaggtttactttagaggtttactttagagggttgtgttagatgtagtttattttaaaggttaaaggtagaggtttgtttagataaagtctactttaaaagtttgtttaaataaataaagttgatttatagagacgtttgatagtattactttagatgacaataaaatgtaactgtagagtttaggcataggctcaaattcaagttgttgaattcttgttttttaagattaaacatttactcttggatgtagaaagacttgtaaattgtacctttatttggacatggaaaatccatctaaagttgaatgtatgcgtgtttagtttaaaacatagaaagacctagatattgttgaactctagggttaccgataacaacgtgttgaattggtataaacattattacgcatagcgtattatctatactcatccgtgcaataaatacagtagacttgagcggatagtcatcagtactggttgagccactataccggttagagtaccatcactaccaagtactcgtaccaactactaccaactactactaccctctacccatctatacttgcaattttcaagctctaaactctaaaccgcaccatgtcctcttttctctccatgttcaactattcggcaccttcaagtgcaccggacaccgaactgccggacactatcgatcggtgggtcattctaaagattatcaacgacactcggcacatactagtggatcgattccgtgtatctggagagtgcgttgcacgcatcatacagtacgtggacgatcacattggcgatcacgtttccaaggagcgctttgaggaccacttgaccgagattaagagcatcatcgcccaagagtctatgctactgggctcgttggccgatgcctttttgggctccattctaaagagtaagattatcgaagtgtaccagtctacgaaacgcaaatcgcagagtggatacgtaaacattgacagtgacggggaagagattgaagacgaagaggatgaggacgatgattccaatgatgttgatccagatgcttatagagggcacaattcagacgatgatgatgataatgactctgatggaggtgccaacggttctagagatggtaacaatagcactgacaacaagtgccagaaagagtatgaaaatcaaaaagagtcacagggtaaagaattcaagggtaccgagtcgtcaaacaagcgtcgattcacctctgacgagtacgtgtacaacattaagcgtttccgcagcagtgaggaagagtttgaatctgaccaaatgccgaatgcgttggatttgaaggactactatggtgacagtaccgatgaatccgagtctgaggatgaattgaagactctagagcacaagccaaaggaggtggatatttcaaccattcttccaaagggttaccgtttggttgataacaacaagttgattagagtcgactactataactttgtgaatgagcctacggatgagcctgatgaggagtctgaggaggaggatgagaatgaggatgaggataaagtgtttattagaacgtatgcttcaaatgtttaattgtagagtatggttgcataaggtagagtaaggtgtgttgtagttgtaagatttgtagtttgtatttgaagggatctttaaagtttgtgggcatctaaagtgtaattgtaacaagtgtaattgtacttgtaattgtaattgtaattgtaattgtatttgaaattaaacttgaataaaaacactatgtgaattgtagatttttgtattttttgtataccaaaaaatattaataataatgaatacattcctaaatacacttgttgaatacattacctccacccatttaataaatacattacttaaacacattactaaaggctctacacaatcatataccttaactagctaccactctggatgcaatataatcccactccaaatacacattatggtaatctcccccagcatcactacaaatactataatgaccaatcttcggtattggtgttggctgcttgcaactcgtcaaaagtcacaacgccagcctgtctgagtgtaaagctctctagctctctgagcagtcgttccaagtctcgaaccgcctcagtgtcggccatcgaacccagtacggtgagtgcattctgcagcttggcaatggtttgaatcgaactgatgcgctgcgatgcattcagcgttttgagctcgtccaacagttgacgcatctgttcgggcggtatctgactctggctgacttgtcgcactccgtccaccacctgttgcattatgctctgtaaacgctcaaagttgaacatgctcaaaaacttgacaatttcctcgttctgagtgagcaagtttcggtagcgttcatcctgcaccttttcgctctccacaagggcctgcataaagttttcaatgttttgattgactacattttttaggcgtaccgacaatcgatccagcagaggttccatatagtctaccagatacgattccaggctagtttgtatggcagcctttatagcgtcaattttaggcatattgttactactgctactactaccactaccactactactcttcttgttaccctcttcaatcaaacgagtcaagtgatcctctagcgcattgatttgcttttcgtttgatttggccatcgagtctagtcgatcctggagtgcattattaaggtggtggtgttggcccacatcatcaccactacccttgaccggttcgtgtatagtctgcgacaagtcattgatggccaactccattagattgagtttgtcattgatcgtgttgagcaagtcgatgacgtgcacgtccggcttggtctcttcgggctcgagctttacaccgtccatgtagctggccacgttcaatttcgagtctgattctgggctacgtattcgattcagatagtcggcatctttacgatccaccatggctgcaaagttttcataatccatcatgccttcatatttgctagaatcgtactcttcaatctgttcgagtggtcttgcattcaaagttccattaggcacttctacaatactatagtttgatggattgttgtcattattagtattagtattagtatttagaggacctacattctctacaaatgtaggcatcggtagattgccaacatccctagcattaccactagctcccccttgcactccacgtacaaccacagacgtaaagtccatcggtacagtgtacaatgtctgtactcgatccagactctgcaacagtctatcggatgcggcaataaccttgttgtaaacatttacaaagttcaagtaggtctgtatcgagactcgtttgatgtttagggtgcgactgacgattcgtctcagagtagtaaaacttgacgtgtcatatttcatgcctgtggtgatcaatgtcaagtcgttgagttgatcgctaagggtacgcgacgcgtgtctgtattcgtcgttcaaaaaggaatgcaagtcgtacaagtctacagaatcgcgcagtagctttattcgaacagagtttattttaccctgagccttgtcgtacaacggctgcattgaattgtacatgcgcgtgattagatgaatcagttcggtcgttgcactcttaaagtttttaaatgtgtactcggtcattgttgcacagtcgcacaagctcagtttacactgtatcgatcagtggcgctagtagtctgccgtcgggtgtgtctttgagttttttagaatcagtgctcggacctttcttgtaatattcgcacaagggaattgtcactaatcgctctacaataaccacaaagagggcaacgaccagcaacaatagcagcattgtgcgtgtcaaatcatttgtgaccaatctcaaacaatcgagaagtcgccatttaatggcagcgcctagactacatgtaagagcatattggcgttatgcgtatatgtgcaaagttttaaaggatgataaacgctgtccgttttattcagactagtgtgtcagagcaactcgtgtattcatcatgaatcttggaatgctagtcagtttgatcgcgttgagcgtggtgtgcatttgtaccgtcatcttgatgtggttctcgttgcatacgttgaacgccaccaagattaagacaccacgcgaactcgcagactttataagcactcatatgaaaaagaatggcacctttaccgtagcgtttacgtatcgctacaacaaggataccaacaaatatgaaaactactatgtcgacagtttgggtaagctagtgcgcaaatacgaagacttgccgataaacaatctaggcaacccggtcgacaacggtagagtcaacaacaagcgcaaggctagagacgacgccagcggtgccaaaaagcgcaagggtctaatagagaacgtgtccgatgagggtttcacagtgaccaacattgaaggtatgttcaagtgtccggacaattggatctggcgagattcggaaaagatgtgcaaacccaaagctatatgtcaagtcgacgacccgatcggtacaatcaagggtctgccgaccaaggatgcctcatcgcccacactgtaccatccgcgcgtgtacgcagtgtgccagggacccaccacggaaccggtggtggtcgacgatgccgactatgaatttagggatcaactaacttccaacccaaaagtcaaaattaaaactggtcgttgtataaacaacaaagtctacaaccaaaaactcgtaaaccgtgccggtagcgatccgtgcgtattttatgacgtgtgtcaaaacaaagaggacggttatactcatgccgataaaattaacgattacacgcctagcgaatatgaatactactcttgtcacaattcaactagcgtactcaaatcgtgcaaagccggtctaatttatagcaagattcttaaaacttgtacttttaggaatttgtgtaacgacaaaccaaacacgtttacgctaaagattgacgatactcgtttcctaaaatgcataaactactcggaggccatagtgtcttgtcgcgacggtatctacacgcatcccgacggtcggatggagtgcgtgtcgttggcctgcaaagcactgtacgattccaatccggagcatcatttcagagcgttggagattcaagactaccggtacatgtcgtacgttagcgctatcgaaaagtgcatagacaacaagattcacaaaattaccaccggtaatcgatcaatcacctacgctctggaaacgcgctccggtgaatactatacggttacgcgcaaacgtctcaccgacgatccgatccgagtgcccggttcgattatagacaaaactggccaaatggtcaccgttggcactctggaggcactcagactgctggcggatcaattgattgtaaccaatcctataacgattcgctacaactatgcatcgccgtggttagagtacgatctcttcaagggtaggccgtttaatgccaaaaagtggaatcgcgtcgcagacgtggacaatccggttagcgtttcggtcagcgatacagacaaggctatcgtcttttcagaatactatgaaaacattgagaccaaacagcgggtaccgttcaagtcggccatgacattctacagtaccaatagaccgtactttttcaaggatcccgatgaggatctggtgcacaaggaactggcaccggacggtcacgtactgtgggcaatgtttagacgcaaacgcagtcagccattggacatgtacagcctgtccaatctgttgacgacaaagggcgccttttacgtgaccgaagagtttatcaatacgggcatcgttcgcatggtggagggtttgccgtttgacggtaaactcatcaagaacggtaccgtgatagagtttaaagtgtttatgaacgatcgctactacaacgttaccgtaccgatagccagcagtcaacagctgaaacagtttctagtcacaccgtcggtggtgcagccgggttcgtttaaaacgatcgagtacgacgagtccaagtttgactatgacacgtatcgatactttatagtgaccaacattatgtttactcaggaaacgtttgtggagcacgccttttcggccgagtctgtaccgtgcgtgtccttcttcatatcgctgttgcctctgtccataatgggttggttgggcgatgttaaagactttgactatcgaagcttctttacacaggacccaccgattggtggcagagagcgtcggcagaatatggatacggtggcaccacagattgtagaattggttctacctcccactttggaggaggtggacgagtcgattgacactgacgaggtcgtggacgatgctctgcgtaggcgcaaatctagaatcgtagactctagcgagattgctgaatttgacaaactgtacaagtacacgcgaatggtactcgattcgggcaaagaattgaaacggcccgatgaggattacgatgcgtttgtggcagcgttgcctagtagaattatggaaaagttagagagggaggggaaatagaggtatagtttgaaatagatgtatagtttaaaatggaggtatagtttgaaatagaatgtaaaaatataggtagtgtaaataaatgaaagtagcattactagttttagattgtagactatggttgtttatacacacaaataccaagagagagatcattaaaactgttgggtataggatttggtatacatgataggtttatagaaaaacaagagtacaaactaaaaccatacacaatactggcacactggtacaactacaggcacccgcacactttcaggcaagtggccgcatggtcatcaaatgggtggtttttgatgtagtgttttatagtgtgtgttgttgttgttttgttgaatgttgtcaattttagtaatgtagatttgtagatgcaggcttgtacacaattgtaaattatagtagatttgcatgtacctatagtttgtgtagtttgcttggagatttttgctttgagtattttacaattgtaaaggttttgattattttgatcaagtatttaaaatacacaaccattggtaaactacacaaactgaagcaaaaaacaggtagtgtggtgtaggcatagaggcatgcgcgtattgggttacctttgtttggtttgcatttccaagtatgcatatgtgtgtatatatttatataatgtgtaattataatgtgtaattataatgtgtaattataaatgtattcttcccattctattctattcaactctactctttatactaacaaacttgcatttgctttaaacttactaacattcacactactcgatctgatattgactaaactaatgaatatctcttgtatgtttatagatggtgacgactcgggaaaggacaaagctggggacacggacaaggctggggacacgggtaaatctgtagagggaaagaataaaactctagagattatgaatcaaactatagagaccaagaataaaactgtagagggaaagaataaaactgtagagggaaagaacaaaactgtagagggtgagagcaaatccaaacctgccgaggataaaaccaaaccggcagaggataaagacaaggggaaagacaaggggacagacaagggcaaaggcaagggtaaaacgactgaggacgaggttgaatctgacgaggatattgacacagacgttgacactgactctgatgaagacgaatatactgaccatgatgaacgaaacaattcagctaaagcatttttgggcgcgtttgctgaatatgatgaggaggcggccaaatcggctgaggagaagcgcaaaaaggcaaaagagttggaacttgctgatgtacccaaagtgaaggatggtgagggttctaaagcaaaggatgaagctaaagcaaaggatgaatccaaggcaaaggcaactcctaaatcaacagagaagcctaaagcaaaggatgaatctaaagcaaaggcaactcctaaatcaacagagaagcctaaagcaaaggacgctcctaaatcaacagagaagcctaaagcaaaggacgctcctaaatcaacagcggaacctaaagcaaaggcaactcctaaatcaacagatgaagctaaagcaaaggaaactcctaaaccaaaggatggttctattcccagctcacttgtaccagattttgaaagtgagccagattacgaatcggatgaagacgagtcttccgagcacgaaataacttctacaacactattgaatgcgttcaacaaattggacgaagagagtcgtaaggaggctgctggtagcactggtactggtagcactggtactggtagctctggctccggtactggctctagtactggtggtggtggcaaatttgccaaacctacacccgattctagcacaccaggtaaagacaaacgagaggttgttagaatagacacggttggtgatgctggctctaaatctggtactaaacatgctgttgttaaatctgggattggtagctctggtaaaggctccgatactggctcgggcacacctaaagttgcagtagccgactctagtgttgaggatgaaatgtcagagggcgaagaggagactgatgaatttgatgaaacgagtgcggctgaggcagaaaaggctcggaaggttttacttgaacttgaaaaaggttctgttgctggaggcaaagctaaatctagtgatgtaggtggtgctaaagtagatgacaaaggaaaggaatcaaagagtcttggtaaaacagaggacaagggtgttaaagtagatgacaagggttctaaagcagagggcaagggtactaaagcagaggacaagggtgttaaagttgacaataaagaggaacctaaagtagatgataaaatagatgacgaatcagacgactctggtatggacattgatgaatctgatgaaacatctgaagaagaggcagaaaggaatcgtaaattgttaatgtctacatttgaaagtttggacaaggaaaagcctgaaaaagtcaaagttgacgacaaggcaaagactgatgaaaaagcaaaggccgatgccgcagcaaaagctaaagctgaggagaaggctaaagccgatgccgctgcaaaagccaaagctgatgaaaaagcaaaggctgaggcgaaggctaaagccgatgctgctgcaaaagccaaagctgatgaaaaagcaaaggctgaggcgaaggctaaagccgatgctgctgcaaaagccaaagctgagaaggctaaagccgatgaaaaagcaaaggccgatgctgctgcaaaagcaaaagccaaagctgaggagaaggcaaaggctgatgcggagaaggctaaagccgatgccgctgcaaaagccaaagctgaggagaaggcaaaggctgacaaggctaaagaatcaaaagaactagagtcaaaggataaaactgaaacacatgaagatgtaccagatgagttggacgagtcgggttatcatgaagatgaagagccaaccggtgtcgattacgaaaagagcaagcgtgcattcctaggtgattttgatagtggtagcagtggtagtggtagtggtagtggtgttggtactggtgttggtactggcacaggtacgggtaagagtactggtggtgctaaggatgaggttgatgctaaagagaaaactgaatccaagccagaaaccaaaccagaatccaaaactgaatctaaagcagaatccaaacctgaatctaaagcagaatccaaaccagaatccaaaacagacagcctagatgaactaatgcccgagtccgtcgatgcatcgctagatatcgaagagatcgatgcctccagtcacacagttgatcgtagctttgtcgatgcactagacggtatggatcatgaaaaagccaagacggcgctaccgtcaatgagtaaggttgatgatggtaaagtaaagaaacgcaagcggtcaaaggagattgatgatgttgtagatgcaaagaagacaaaggaagctagtggtaaactaatagttgatggtacactaaaagatgatgttgaaccaaaaactgatgttgaaccaaaagatgaggttaaatcaaaagaggacccaaaggacaaagctgaaccaaaggacgctgctaaagaaaaggagggtactaaaccaggtactcgtgcttaactatatacatgatttgattagatttactttgatttgactatacgactcttgttgtactatgctcataatatgtaattgtatcatttaacaaaacttttgtattgcatcttgcaactcttgtactaaaaaatatcttgtaataaaaacttgtaataaaaaaatcttgtaataaaaacttgtaataaaaaaatcttacaataaaaacttgtaattacttgtaataatacttgtaaaaaaatcttgcaataaccaattcccaactaaatattgtaaactttatattgaattctgttctgatttttaatcatgtcaattttaaattacaggttctgcagacgagccggatggatactcgtacgacagtgaagaagatcttgagacgcacgtagtaataggtaacgttgacaaatcatctacttctgaaacagtagagccaaagggaacgttaggttttgtggatgtgaaagaatctacagaagagggtacaagaaaatctgcaagtttcgatagcacgcataaaacattattatcggtagaagacattacagagcttaaggctgcaatgcacggtaaaaaaggcgccaaagagaactttgatgattctagtgaaattgttagcaaaaaagcaatgaagatgggtatagggtttggcgttgatgatgatggttatgagaatatatcagactcggactctgagtctagtgtagaaacggttgctagtccgcccagtattgaaaaggaggttattgttgaaaaggaggttattgaaaaggatgttgttgaaaaggaggttatcgaaaaggttgttattgaaaaggaaaaggatggtattgaaaaggaggttgttgaagaaaaggatgttattgaaaaagaggttattgaaaaagaggttattgaaaaagaggttattgaaaaggaggttattgaagaaaaggatgttattgaaaagagtagtgtagcatcaagtgttgaaactggtggtactataccaagcactgaaaaggcaacaaatccacccaccattgaaaagacggttccagcaacggtgctagaccctacactagttatggaagtggatgaggatgacgatgactatttagaggcagaaccaatggatgtagatatcgagtccgagcctgaacccaagagtgaatcggttccaaaggatggttctgtagagacaatgaaggatagcactttagagccaaaagaggtaaaggttgtaagtccagttatagattcaaaggaaaagactgtagatgagaaatctgaaatgcatgtagattcaactgtaggtaaatctgtagtggtttcagagccaaaagtagtcgatgtcaaggtagatgctaagggtgatcctaaattagattccaaagttggtaaattggatgataaatcggaggcaaaaactgaacctaaaaccgatgctaaaattaatataaaaacaattgaccctaaagtagatggtagcgttgaaacaaaggcagagcccaaattagacaaagtggatgataaatctaaagatgaggttatgccagaaagtaggccagaacttaaaccagaaagcaagccagaaattataccagagagtaagttagaaactaagccagagagtaggccagaaattataccagagagcaagtcggaagctaaaccagagagtaggccagaaattataccagagagcaagtcggaagctaaaccagagagtaagccagaaattaaatcagagagcaagtcggaagctaaaccagaaagcaagacagaaactataccagagagtaggccagaaattataccagagagcaaggcagaaactaaaattgaccctaaagttgaatccaaagaatccaaacctaaagatgcccctaaagtagagctatccaaagctgaacccaaggtagttgaaaacctaaaactgatcctcctaaagatgatccagaaccaaaagtagaaattaaagttgtggagccgcctaaagctgaatctaaagtagtggtagaaactcctaaaactgtagaacttcctaaagttgaatctaaagtagtggaccctcctaaagctgaatctaaagtagtggtagaaactcctaaaactgtagagatgcccaaagttgaatcgaaagtagtggtagaaactcctaaaattgtagaaccacctaaagcggaatctaaaacagtggaccctcctaaagctgaatctaaaacagtggaccctcctaaagcggaatctaaaacagtggatcctcccaaagcggaatctaaagtagtggtagaaacacctaaaacggtagaaccacctaaagcggaatctaaaacagtggaccctcctaaagttgaagttaaagtagtggatcctcctaaagttgaagttaaagtagtggatcctcctaaaactatagaaccaaccaagactgtagaaatgcccacaattgtagaaacacccacaattgtagaaacacccaatccttcaactcctcctgatttcgatgaaccatctatggaatcgttcgacgaaccgatggatgttgacgaggacgaaatagctccggcattcaatccattcaatgtagttgacaaagagcgcgaagaggttaaacgcaaagaggacgaagccaaacgtaaaaaggccgagtctgaagttgagatgcacaaagatcatgaaatgcactctagtgagtttgaacctccatccattgacgagtccgaggagaccgagactgacgagtacaaggctagtgcggctgcatttaagaatatgttcagcagcatggatgccggtgaaatgccagaatcgattcaacgcaaagatccaaaaattgtagatgttcaaccaaagactcaaccaactttaccaaaggttatagatgtacctcccaagactgtcgaacaacccaaacgtaaaaaagagccaaaacgcaaagaggaacctcccaagactaccgaacaacccaaacgtaaaaaagagcaaaaacgcaaagaggaacctccggtaattccaaaaactatcgaacaacccaaacgtaaagaggacccaataaaagaaacaccaaaggtggacgatggtgaagccaaacgtaaagccgatgctgaagcagcaaagcgcaaggcagatgcggacgccgccaaacgtaaagccgatgctgaagcagcaaagcgaaaggctgatgctgaagcagccgaagccaaacgtaaagccgaggctgaagctgctgccaaacgcaaagcggaggctgaagcagccgaacgaaaaagaattgcagatgaaatagcagccgaagccaaacgtaaagccgatgcggacgccgctaaacgtaaagccgaggcagaagcagcaaaacgcaaggctgatgctgaagctgctgccaaacgtaaagccgaggctgaagcggcagccaaactcaaagccgatgcggaagcagccgccaaacgaaaagcggaggctgaagcagccgaagccaaacgaaaagcggaggctgaggcagccgccaaacgtaaagctgagattgaagcagccgccaaacgtaaagcggaggctgaagctgctgaacgaaaaagaattgcagatgaactagccgccgctaaacgtaaagctgaggctgaggcagccaaacgaaaagcggaggctgaagctgctgaacgaaaaagaattgcagatgaactagccgccgctaaacgtaaagccgaggctgaagcagccgctaaacgcaaagcggaggctgaggctgccgctaaacgcaaagcggaggctgaggctgccgctaaacgcaaagcggaggctgaggctgccgctaaacgtaaagccgaggctgaagctgccgctaaacgtaaagccgaggctgaagctgccgcgaaacgcaaagccgaggctgaagcagccgaacgaaaacgtatagaagatgaaaaacgtattgcagaggaaaaacgtattgcagaggaaaagcgtattagagatgaactagccgccgaagccaaacgtaaagccgacgaggaagcgaaacgtaaaatcgaatcaggtgaatttaaactccacagtcgaatctaataaacccataatggctctactttataaactgttttactaatcataaaccttttctcttgtttcagaacccagcgaagagtacaacggaatggcagactttatggccgacctagaagattaaataagcacatcataataataatgtaatgtaatgtaatgctaagcgcaaagtgtcgagtgtagataagaaagcaagtttatctaaaacgtattaaaagcaaagtgcaccgagtgtatcaaatgcaaaagttttactttgtaaatgtaaatgcctgtgcagttttaaactgtaccatagcgtacacacggtctaaaactgaacaagcataactttagacctaattaataattgcggataagaaacaatgtatgtgttttaattttataggttaatatgaaagaggttaagattttgattgtagaggttggttgcacattaggttaagtgtagtatattttacttgtaatatacttgatcgattttacttgtaataatatgcatacttgcttgtatgtttgtactctatacttgatgttgttagaaatatagaaactgatttcatttatcaattccattagttgataattaaacaaaatttcattagttgataattaaacaaaattccattagttgataattaaacaaaattccattagttgataatttaacaaatgagaatattttcatcacaactttacaccaaatgtattttataaaaaataaacacttgtaaaaaactacttgttttttagtcaaaaattacttgtttttttaatcaaaaaactacacctacatctacacctacatctacaactctatccaaaattctaaacatctctagtctttggtatatacaactgtttggtataggtatgcatatacaccatccacaacaccccacacaacaacaaaggaaacagtgttgtgcaattgtgtgcaacaatgtaacaaatgttcaactcttaataaaaaccgacacaaagtattattctgattattacctcctccttctggccattttcataacctttcatcacggccaagtatcaatattctcaggtttgagtataaagcaatagcctattggtgttatttcaccggtcagtattgtagtttatgaaacatttttcttgtattttttaacaatggacttttgttgtgtaggtttataggattgatattgtgggtaggtattataaatggtttacagtatcgtgtgtgtgatttgtgtgatgtaaccttactacactactaataataatacttttgtaatgtgtgcgcatgcacgtactttttgcacaatagagaataaaactttatagtagatgaaccagggtgtaataaaatggtcaagagtattgttttaatatgggtgcatcatagattatgacattaggtaaagtgccgagtgtagaggtgtcggtaggtagtggtagacatctagcaagtatacgtgtgcatatataggtaacatttagtagctctacatgccggcagcagctagccataaacctctagtccactttcaagaacttggactctaaaaccaaacattaaacacatggtttaatccacctttatgtgtgcatcaaggttgaattcaatttcaagcgagtgaattatttcacaccattcagtgaccagaaccgggcgagtacgggagttttgcagtgtgtgcaccaccctacatgtagtagtattatagtagttgtatgtatagcattacatacaaacttttgccactctgacttcagtctgacgcacactgtccactgtacatcattactggagatgtctagatacttgtacatttctagttttttagactggggttaaaaagtcaaacagtgtataatagagtacctactgtttttatagtatataccatgcttgttaatgaatctgtgcagtgaaaaacaagagtcgcccaatatacatggacttgactttgtataaatacgcgtgtgtatatagtagtgttgctactttgaaaccaaaacaaacaaaacaacctacgctgtagtacacagtcataggatagataaacggacaagtataaaatacccgcgcacaacacctacaccaaccatagtgcttttgctgttgaccagtgtggactgtctggactgcaatacctactaatagtactacctattgtattattgtggtttttaaataaattaaaataaaattgaataaataaaatttaaatactagacaacaaaaaatggaacccatggagtgcaagccaagtacctgcattgagagtggtgttggtggtggcggtggcgaagagtttacggcacctacgattactacaacggccgcgatcaatgctgttgactcggactctaacctaaacctaaatccaagcaacctaaatccaagcaacaacatcatcaatacaaccaaccctactactactacaacaacaactgcgacaactgctacaactatggccactaatgatactcctccaaccactgccaccgatgccgccaatgccactatacacaactcggcatcggcatcggcatcggcctctacatctgcttcatccatctctgcgtccgtctccacctcggcatcggtatctgcatccacaaacgattgcaactcggccgacgagctaatgagtacgttgcgtcaaaaactcgtcagactcaaggagcgcgtctttaagaattgcaaatcaaaactaccgacgtggaacaacaccgacgagactataaacatggtgcgatcgcaatcgtgcataaatcggtgcttctttaaactggccgaaatggatcaattgagcaactttagactgagcaacgatgccggtctgtttatggatctgtgcgctggaccaggtggttttaccgagtacctgacctacaagaattggtccaactttggcatcgtactacagcatcgagacttgccggtgcagattgaaaagctacccaatccggcagccgtcaaggtgtacactgtggacctgttgaacgctcacgatcgcgatcgctttcgacacgatatgggcatcgtcaaagtggacctggtggtggccgatggatcgatcgattgccgtggccgtgaaaatctacaagagccgctcaactatgacctgatccgagcccaagtggacgtggcgtttgatcacatcaaggtgggtggtaattttgtattgaaaacgtttgatgcattcaccaatcagatgctcaatctgtactatgagatttactcgcactttgaagagtttaccgttgtcaaaccgaacacgtccaggccggccaatgccgaacgctatatcgtagccatgaactacaagggtgcaatcaaaaagagtcaacatgcacccttttataataacaatcacaataatcaacatcagaaatttgagagttacaagagtttccattacgagctagtagccaagctggcacagagacaaattagcgcattgcatgatttactgaaacagacaaagaatacccccttgtttgagaatggctacatgtttatgaagaacgccaaatgtacaaagactctgtttagcgtcactcccaaacttgtagacagtctaaagtgcatcaatactgtggatccggatttgttaaagtgtacacgacgagtgttggccgattcaaagagtgactatatcggttttataaccacctcaaacgaaccgcacaaactgagagtcaaacttgccaaggacgatggaggtagacgacaccagtacgattacggtgcctcggcttttactggcactggtggtggtgctagttttgatgctggcattgacggtggtcgtcgtggtggtggtgcagtgtacaattgtgtgaggaatcaaaatcagttgagtttgaatcagagcctgtataagcaacaacaacaacatcacaatcaatatccatacagtaccaaaaacaatggtcattgtagtactggaggcaataataataacaacactgccaacaacaacagaggccaccgttatgccaatcgtcgcgctaaacagtttccgcacttttattactattttaacaaatctggagcaagagtgactgcggtacacgtgccaataaatcagttgaaaaatacacacaaggtccagtgtagagttgtacattcgatgcaagttttgagcgactatacagtatcgtttacacttccaccgggcgtggtcatgtttgctctgtttaacattgatcacaaaactaaacgtttatacaatgtaagactgttggacttgatgcaaacgtacaacgccaactatagcggtgactcgttgcaggtgcgcaaaaagattgttaaagagtttaaatacttatacagcatcggccagcaggatcctaacggaaactgcgatataaaccaacgggaaacagctggtgatgcaaattatcattacaacaccaattacaataatactactactaacaatgcccgagagtccaagtttgataccgatgtattattgaacggtagaggttcgtttaacatgtgcaccaagtacattaccgtgctcgatacacgaggcggtgatttggtcgaggacgatctagagtttggtagcgagataaaccagcaacaacaacagcagcaacagcaacaaccacaaccacaacatgcaccatctggttatataccggtacactcggacactgtcgaaaccgatcccaatggtggtggtggttgtaccagtagtctgccttctctagacattcatccgatgccgtctagtgcaaagttgcacagagccagcaacgtaatgtgtctcgacaagagtgaagagtttgtcgactgtgccctcatcgatgacaagcccattgtgcagtatgcgcaacgcaaagactcgctctttgaagcacccatgaacttggacacggacgataccattatggacactatggaggaagaggtcgtagagagcggcggtcccagtacgggcagtagttttacgagcaccggtaccgtggccaccaatgtaatctatcctagcagtgtgagcgcagcctctacggcaaaggtgaaccagtctcatttgatgtacgattggtgtgataatgatttttcattttagttgaagtttctacatttatactatagattaaactttattcaatgtaaacatttttagctattggtcttgtgctttaatgttgtctgtacaatatctataattgtacaatatttatgattgtacaatatctagctattttgctgtataattataaaatctttcatgattgtataacatctatgattgtataacatctagtgtatagttgactgtacaacatctagttgacatcaagtttgcattttagtcataggtttgatttagagggttactttagagggttaatttagaggtttaatttgcattaattagaatacctacctttgttttggattgtaatgcccaacttttgtgttgagatttattgtcctagttttgtattgtacttttagatgtttatttagatgtacggtgtcggtactattgtttagatgtattgtttagatgtagtgtttagatgtatcatttagatgtattgtttagatgtattgcacttgtaattataaggagagtaggagactaagtatggccacacaatgatctttaaatggtagcttagtttgtagtttaggttgtagactaggttggtagagtagatggtagagtaggatgttagagtaaaatataaaacatgtattagactgtaatactcatttaatcaaatatattataattacatgtattcctaatgtattctcaaaattgtatctttgaaaaataaagcacctaattgagtacattcttgttttttagtcactataaaactacctacctatgataaaagaccatatactaaaacacctacctaactacctacttacctaccaccctacctacctacctacctatctacctacctacacacactacacattgagattgtaagctcacctaattatagactctaaacaatagccaagtggtttcatttcaattttagttcacttcctcaataaacggtactacatcatagcagttcacagcaccacatttatacatggaaataaacttctactataggtagtaggtaggtacgcattggtagaaatacaaccacaagtataggaaccatacatgtgtacagacctaggcatttcctgtgatcttctccacattttacaccttcctctctatacccctcatttatatccatctatattaatttcaaatttattatcaaccagtaaccaatttagataatcctatttatatttgcatttatacactttaaccatttcccacatttatccatttcccatttataatcatatcctttggatgtttgttctacacacccgtgctcaggttcattatctgaaactcgtaaaatgagatcgtaaaaataaatacatagtgggtgcgattatttgcgcatgcttgttgtgcattttaaaattgaatgggatctgtactaggtgtagtgccatggagcgcgacagattagcaacagcagcagccagtgcacctagactctatatttgtgacacagagggattaatggttcgttaaaatcatacaatattatcaacgataaatactgcgctgctagtattaacggtgttcacagttatatatattggcagagttaatacctgatgtcgtatacgctgcttgtatactttaccgtgtggcggtcaagagttgtgcgtgtgcgactgattaaaaactcggtgcattattattctagtgtacagtgaataatagttaccatttatttgtacaattacaaactacaaactataaaatataaaatataaaatataaaatataaactataaactgtaaattataaattatcaactacttacaactaatactagacttatattttacacctacacaaattggtacacttgcaagatttacatacacagaaactatgaaacacaaaaacagcaagaaactcaaaaatgctacaaatcactctaaaacatatcaacacaaaaagtacaagaataaaagatgtggtaccaatcagagtgtcacggtcatggaagatgcggtcaatgccaccgctcaacacaaagggtacaatttgagaaaattgcaatccaatacaaaacaatcaaccattgtggacggtcagtcaagtgaacagtttgccaataataattgtacaaaacagcaccagcaacaagagcaagaattcgacaccaggcatcggcaacacagggtgcgcagaaaaaggcatgcaaaggagtctaccggttcaaagactagcagtgatattggtagtgacattggtagtgacattagtgatggtcctagtgtaatggatggtcctagtgtaatggtttcaaagtgtgtctcggattgtccagtaaagtgtggtaagattggtaatgattataatgctacgactgctactactagtattgatacaagtaacaacatcagtactagtagcaatatcaatactagtagcagtatcagtgctagtaccagcatcagtactagtactactgctaccactacttttactaataacaacacaatttgtaaaactacaagcacaaataatattagtggcagtggcaattctctactcagaacatcattactgtatcccaagagattgttcaaacaacctacacttgcaactaaatgtgctcctctagccaaacacacatcgttgccgttttgtctgcatctttacactccacctgctcatcctactagtacgcctaccactactcatactaccactactcatactactactcatactaccactactcatactactcatactactcagcatcatggcaatcctctaccttggacttgcaactattcaaattcaatatatcccaatcagtataatgtgaataatcaacagtatcagaatcagacgcaaactcatactcagactcagaatcaaactcagactcagaatcaacaaccgtgtgtcaattgttacaagggtatttgttgtaatttaccaatacctcatcctccaacttgtacttgtaatcaaacctacaatcaaaactataaccatcaaaactacaatcaaaactataataatcaaaactacaagcaagactacaatcaaaactacaaccatcaaacctacaaccatcaaaactatactccatcatcctacaaccatcatcaaaattaccatcaaaagaagtatcctccaaattatacacattctacaagtaaccatccaagcaatcgcacaaacaataccaacaaaccaacctactactataccctagaacactttgcacacttgtgtgaacgcgtagccgcaaccgatcaaatgtcggaaaagattgaaatcgtcaaggtggtctttgactattgcgacgacgtaaagctatggtgccgcatgctattgccccagctcgaccccagagtgtacaatctcaagactagacagttggtaaaaatgtacgctcgcgtcttcaacagtctagtcaacaacagtaacaacaatagtaatggaatcgatttgacacgcttttactgtaattgcaaaagtaacgatgtcggtgctaaattgaatagattggaaatgttaagagtggaattgctacaaacgttaatgtttaaagacttggagagaaccggcgacgtggctcagactataatcagtttctttaacgaacaccattacaagtttcacagagagtgtaataaaccacacaagtgcaattttcttttgcaagaaactaatgacaagaatgcatctaaaccttacaacaacaatgaaagcgttaacgctgaggccttttatagaccccttgtacgtaaagaagaagagagacaaagaatcacgatgcctcaggttgacgagtttttaagcaacatggctgacagttcaatcactggcaaacacgcactattgtacgagataaccagacgatgcaactctatggaactaaaatatctaattcgtataatgaagcgcgacttgaaaataaacgccggctcaaagtgcatactggaagcgttgtcgcccaccgcatacttgatgtttcaactgtccaaagatttcaaactagtactggacctacagtgcggagaggataatgcgtcgacctttttagaagatccattctacgagtctggcagtaaaacaaacacaaatagaatcaacagacccattcaggacgttacggatgtgttacatgccaacaagtttgagaacccgtacaagctatactacaacacaactacaacaactacttttagacagtgtacgtgtacaaatatagctctgtacaatactatacctaatgtaattaataatggtaataatggtacctttcaatattcaaacgatgcaataaattcccatgatgtgactttgcataatttgcaattgcatcaatccaataatactaacaataattctcaggacagtgtacaatttgaaaatgctagctgtgtgttgggtaatcatttaactggttcatcttttagtacagggggtactgcttttagtacaggtggtaatactatcagtacaggtggtgctacttttagtacaggaggcaccactttcaatacagaccctataaacaattctctagaaccttggtctttggtagagtgtccatcaaacaatgtactaggagatgtggtgaactccgagtctttgccttttaataatgtagaatcgttcaattgtatggagccgttacctttcaatagtatggaacctttgtctttcaatagtatggaatcgttacctctcaatagtgtggaatctttcaattgtatggaacctttaccgtttactaatgtagaacccaccaacagcatgaaccataacatcgaccagtacagtgctatagactcgctatcattattcaatacttttaataatttagactttcaagttaataacaatcaagcacttgatgtcgaccaagcttttgactctaaccttaatcaatcatacaacaatcaagtctttaatgtaaatccaaaccagacctttaatacacctcaaacatcttttaatacaaatcatacacctcaaccgtcctttaatataaatcaaccatttaatataaatccatcctttaatataaatcaatcattcaatacaaatcaaccatcctttaatataaatcaaacctatgccaacaacagtaacgaccaaccaacatctaataatattcaaactaccatatccgacaatgcacactcttcctataatgtcaactctaatttacaatcctataataccaaagagccatacatttatcataataataacaacaacaacaataactctcaatccaatgcatacaattccaataccagtgaattcaataacccggacaagtcactctttaacaacccatgcggtaacaacattactagtgctcccattgaaaacttgcaagtaccccagactattttagatttagatttccaagagtcgccgttcaacaccacctacaatacatgtaacacaacgtttaacaatctaaacttcaatagtataccatacaatacggtgccatttaatcccttgcactctgacgacaaggccaattttgtgcacgtgcaaccgcaaaggagaccacccaaactacaagccaagtctaaccacaaagggtgtcgtaaatcttgcaaatgtaaaatgtgcaaggactcggtggatactgcaagtgtggtagattctataggtattggtggttgcggtgttggtgttggtagtagtagcattagcggtaaagtacaagattgtagagtgatggattgtagtataaattgtaacatggagtgtagcgtagagtgtagttttgaatctagtgttgatggtgatttacaacatgatgtaaactctactaccaacacaccatccagttccaacactggcaccatcaacactatactcaatcacattagtgtagacactctgggtagtcggccagtaatctcactgagacccatagactctttacgatgcactacaccaaagggcagtacggtcaactgtgttgacaattttgtgcaacctacatctacagtcacatccatgtccaagagtcgacctaggttgaacacaaagttgagcagtattggtatggcgagtgctagtccaagtgttgtaaatactactggtatgaatagtacaagtgcaagtacaagtaaaagtacaagtacaagtacaagcaccaaaggctccggagtcaatacacagattgactttgaagaatccctctaccgcagtgtaattgtacaaactcaaaaactcgatacactgtccacaaataacactctaccaacgactctttataatcctataaattccaatactctatccttttccgagtactttaaaatgctagcaaagatgcacacaacagaggatgtaaaactcttggccagtaccaataccagtgccagtgctgtaaataccagtctagtttcaaatgcaacaagtttatgtataaccaaaagtacaaacacgagtacaaattcaagtataaatacaagtacaaattcaagtataaacaatagtacaagtatagacccatttcaacccgagacaaccaaacaaacctatatacgctattgttataaacctaaaaactctaataaagttgcacgtatacgagtaaatctatcttccaagttgaacctaaccatggacgaaccgatggccacagtggctccgatgttggctgcccagtgcaagtccatagaggtggcctttaaaaagtttcccaatggcatgatgtgcgagtacaagtacgacggtgaacgagtccagatacacaagagtcgctcagatttcaagtactattctcgctcactgaaatgcgtacccgaaaagaagctcggtgacctaacacaattgttgcaacgagccctaccctctgagtgcacctgcatcctagactgtgaactgctcatgatggacacggacactggcaaggttctaccgtttgacgccatcggtgtgcacaagcgtaaagcgttcaaaagcgccaaagtgtgcatcgtagtgtttgattgcatgtactttaacggacgctacctgtaccgagagcctctgtctgttcggcgagacattatcaaagacaacctaaccctgatcgagaatcgtatagttctctctgaacagaagcacatcacctcacccggtgaccttatggaagagtttaaacagtgcatgcgcttaaacatggagggcctgatgctcaagtgtgccaattcgtgctacatgcccggcaagcgtagatggctaaagatgaagcgcgactactttaagaatagcggagacactgccgacttgatcatcctaggcgcctggtacggcaccggtcgcctgggaggcctactctccgtctttctgatgggttgcttagacagcgattgcgtggaaccgacatgggtgggtttgacaaaggtgcacgccggcctcaacgatgtacaaatcaaacaactcaacgacattcttgaaccgttgatggtgcactcggccgcaatggatgtgccctggcgatttgtcaacgtcaaggattcacgcaaactgcccacgatgattgcactcgatcccaagcagatgccggtactagaggtgttgtgcacagagctgacggccagcctatcctttaggtttccgcgtgtcattagaatcagaagcgacaaggattggaccggagtaacgtctctgcgctacattaaagagttggcctctggtgccggtaggctagagtgttgtaatgatcaaaagtctgtcgagatggaggatgcggaagatgtgtaggaggatgagggtagaggttgtaggatgataaatgttgtaagagtgtagagtgtacatgtttgaagaattagtttaagtcaccaatacttttatattgtactttagaatcatccttacttctttacaatttacaattgtactatactttacactttacactttgttataattttatatttatagtttatattttttgtaataaaagtttataaaaatgtgcattacaagtgtttaaaaaactagaacaattaccagtgtaaaaagtaagactatgaatacaatctagaattaaatgcaacttaagtcgacacaaaagtaaatgcaaataacaagtattgttaaaccttaacattaacattaacccgtaaactttataaataaacgtgtgttgctaaatcagtctgtgtctcaatgtttcaactctaaaaccaatcctacctaaaccattaaacactcttattattagctactatgcaacactactgctacattgatgcagaatgcaacatgacattgtactctaaaactcaatcacctcttctgaaaccctcttcgttcaccgtgtctgcatagtagtcgagctcttcaatatcctcatcttcatcatcatcatcatccgtactcttgtctttgctcttgtcgttgtctttaccaacactatcctttactgtaccatcaaccgaatctatagttttggatttactccctgattctttagagggttctggctctttagttggctcggactctatagagggttctgatttagacaattctttagatggctctgatttagacaattccttagagggctctttagtggactcttccgtcttgctctctaaaacatccaaatcagcctttgagccagcctttgaaccaaccgtctttgtatcaaacagcctatcgtaccgatccatcaacagtcgcttgcacaaagtgtacaagtctctaaagctcaagttttcatccaaaacgttgccaacgttaaagattgatctgtagagtaccatcgagtttacagcatagccaaacacgatgagtgctaccaaaaaaactagagcgatgactagcaccgctcccagcgtgcacgacacaaattgagtaaacaccattttatcgttcaattcacaatactcgattagctgctttgcgataatacgctataggtcttatcgccgccaacaagtatagagacgcatgctttaattttttaaacaaaactaaccatgcaagagactgcggttgaaatgtgcatcaagcgtttgaaaaactcttcgttcatcattgcacactatttcatacgcatacccagtttggatttggagattcatccgggcatgtatcaaaagggcaactttttgaatttaaactctaccaagcactatcgagtgttgacggtcacgtatgcgtgcagcgattgtctcaacgagctcctgatcaagagcgaaaacgtactgcacgcctggtactatccgttgatcaattgcgagactctgaccaagggattgtgcatcggtgcaccttggagcatccaaaccatactgtctacgtgtgcagctaccgtgatgggcatcctatttaccaagtatgaagcgtttacggccactctgctgactctgtgcgtgctagtcatcatgattctgtgcatgcagtacaacgtccggcaagatgaagtctacaagtgcatacacgtttaaatcgtactattgtgcactacaataacctatatcggttgtgattgtaaatggtaatgattccttgacgcttctatgcatttgcattcaaaagtttaaaaatgagagtttctttatacttttacgattcccatcatcgaccaactcggccggatgcaccgtccaccgatgtgtacaccaaggtgctgtgtcacgatccatcctcgaatctgggcactgtcggtgtacgtgtgggcaagaacgagctcgtactcggtgcgatagtgttcaagagcatcgccaacatggtgcccgacgtcaacatgtcctatctaatgtcggtgataatgtccacgctgcagggctgcggagaatctttgcaagacgtccagctgtacatttatccgccgactctgtttgagcaccatctcaactatacaaaccccaagaatcgattcatgtactataaaaactttgtaccgcaaacgttgggtgatcacgttagagtttcactaaaagtgtagattttagcataggcagtttctttagattaggacattatatttttttagatacaagcactgcaaacatggacgttgacgatgagcacaacttgatcgagactcgagtacgaaactgtcgcggcgatgacgacggtacttggacgatggaatcgttcatgaaccacatttccgaacccatcgtgtacaatgcggtaacgcagttggatcccaagcagtccaacaatgtaaacgttgcctacattcgcagtagaaacattttactatcgatgaagcacgctctattgcagtacattgatttgttgaacaacacgtttgccatgatagacaccgcctcggtccagcccagagtgttgatcgagaaacgcaccaactatatgaaactcagacaattggccactcgtatgatgagtcgcatcaatttgcgtttgcgtaggctcaccgaacgctacaatgaaatcgaggagcaaacgcaaacgtttcagcgcaaggccaactctctcaagtcgtctttcaacaacgacaacacttctgtggaccgagtacgtagactctttctcaccaccattgacagtaagaacaagattaaaccaatggtcgatgagtttaacgtggttgttgcagaggtgctcatggactatgacaattccaattcggaacagttggtggtcgagtctatggtgctgcctctcaagatcaatcctagctttatgaacgatttacagaatcgtttgaatgtcatcaacaagattgtccgagactatcagacgattcagttgaacaaatcaatcaagggcatgaacaagcctgtggagcagttgaatgtgctcattgataccttggataaagatgtaaaacgcaatgggggaggaaacggtggtgcaagtggaggtttcggtggaggcggtttcggtggatcaggcggcggtggaagcggaggattcggaggatcaggcggcggtggaagcggaggcttcggaggcggtttcggaggctcaggaggcggtggcttcggtggcggcaatggaggagacaccggatcaggaggctcgggaggtgtagatcccaatgttgtagtagattttggaaataatgtcaatctaaatggtaatgtagcgtttaatgcaaatgcaaatggtaatgtagaacctagcggtagtgtaggtggtgtaggtataggagtaggttcgggaaatctcaaaacatttatgccaactctgcagacgcagactgacgatgtcgatagattcctaatgaatcagagtgtacaatcaaacctacaagcaccaatcgtaccgatggatgtaaactttaacaatgcaaatgtcaacactgtaaatccagatgctttcaattctaatgtttttgatcaaaccaatgtcgaaatggttgaagctctaaacagacgcatggtgcaagatgcagacatacagactcagatcaggatgcaaaaccagagcatcgactttgggaggccagagccagagccagagccagcacccaagcctacacccaaacgtgtacgaaaacctagaaagagtcaaagcaaggtggtgcaaccgatcaaagtgatgcccggcacaccgatccaacaaatggtgcagtttgccgacactacaatcacaccgatacgcaatacagacgttgacatgcgtccgagtagatcgtctacaccaaacgaatcgttaataaagagcgagtccgaacttgatacgagcataaatattgtaatggaaccagagccaatgattgaagccgagcctcaacaaaagacccctgtaccaatgagactaccggtcagtattcctttgcccgccgagagattggtcgcgtttagtaaaaacattaacaacaatggaaatgtagatttgtttaagaatgctaacaataacaacaacaataatactagcaccaatacatccattgttagcaacgatacatccattgtcaagcaaactgtaagcaccgacttgtacgaaccgtcaaacgttaaagcaatcatgcagagtagtacaccggtggtgaaaaccaagggcgtcaccaaagccaaaaccagagccatgaagagtgtcaagcagcaggtgaaggctgtcaaacaaaagggtgccaccaaacagatgcacaccgtacaagaggagaccactcagcaaactgtacagactgacgacgatcaaatcatgcaagaaacggtccaacagacggtgcagcaaattaaaactgaaaccaaaacaccaacgaaacgacgaaggataacggccatgaaatcaccccgacagaaacgctacctgacgccagagtttgtcgagtcgagtgatgacagtgacgatgaggattcttccaagcccagtaccagcaacactactagtggtagtaatgctgccattacgcctcctaatacggttacaacacctaccacgagtgcaccacctatcaagagcacaactactgccaagagtgaaacgccggttaagagtacaccaccacctactaagagtacaactcctgttaagagtacaactccaaataagcgtacaccaccacctaataagagtacaactcctgctaagattacaacacctaccaagagtgcaactcctgttaagagtacaactccaaataagagcacaactcctgttaagagtacacctcctaccaatacggttgttgaaactgatgccaataaggttactgacaacagcagcgccagcaacactagcagtgccagtgacactagcatgtctccaccaaagacgcccattgtgcacaaggccaaacgacaaaagcgcaaactcaacgatccctcaccggacgaggcgacaccaccaaagaaggcaccgcctctgttgccgcgcatcatacgaggtgtgacactgaatgcgcgcaacaactttatcgtcaatctgtacaacaacaactaccaactgtttgatcccagcggtgatggcttcgaccctgttcaactgaacaaattcaaacagattagatccatgttcaagcaaatgtttaagaagcagggtagatacaccaactacctgctcaacaccaagattaaggataacatacaggcggtggtgaatcgattcctgggtgctgtgcaagccacgataaaggagcctgctttagatagcataatagccacgctcaaagagtacgagtctatactgaatgatgacattaacgagtcgtacgaagatgaccgtcgagcgtatcgaaataatgaacgcattgctgcactcttgcaacagtaccgcgagagcgatgaattcatcaaagccggcataataacgctaatcagtcaatcggagggtttcgaaggccccgacgtggacgatatgctcaacaagtctagaagtgatacatcagaatcctttgccaaagtgtacgccaaagattatgccacactagatagactgtccaagggtacactggccaagttcccaaagcctagcgtggagccacccaaggatatgagcgtttcaacactggttccgatacactttatttaagagagagcgggtaattgttttaaagtgaagagtagttaatgtttgtataagtactttaatgtttgtgtactttaatgttcaagtgtactttaaagtttcaaatgtactttaatgtctaagcgtgctttaaagtttcaaatgtactttaatgtctaagtgtactttaatgtttgtactttgtttgtactttaatgttgtagagagatgttatataaatattttaatattaaaagtgttggctacatctacatatatattttgtataccagtattgccagtgttcatctagttttagagtctaattttagagtataattttagattatagttttagagtatagttgtagagttttaaaatctagaatttagtctatagagtcaccatcacatggtatgaaatcttgagagtatttatagtagttgtacgagtatctaaaagatgaattgtacgagtatctaaaaggagtatctaaaagatgaattgtaagagcatctaaaagatgccttttatgcacaattggtaagaattactacaaggataatgtttgtaatacaacttatttttttattaaaaaatataaataattaaatataaatatatttatactacaataccaagtattattcattattattcattattattcaaagtaaattaaagtaaaataataccacatttttttatcctctacaatattacatccttggtatataaatctcaacaaaggtgcacaaccgttaatacacaacactcggtcatcggtacattgcccgcaaacacaacagcaaactcaactctccaaaatcaactcgttcaaatactcaaacattttgaccgattcaggtttggacagtgtgtacagtgaagtgtgatctccgggcatcactcgcaacgatgcaccattgttgtgcgcaaacgcctcactagagtctcggatgaaatcgtcagtgtttgtgagtacgtgtatacgatccgtgtagctcgctatggacaagggcaccggtgtcggtagatccttttcaacataaccaaccgacaagagtttgaacattagaaacttggttgtgctactaccgtagaatccattgatgccaatgaatcgactaatgtacatgttgctactatcatgtttagtgctgccgttgatgagtctaatcatgaggatggcgtaaaaggcacctgccgagtgtgccactataaagtactctttgggtggatcctttgcgtagagtgttggaatgtagttgacaatcaagtctctaatgtactcgacaatgtctcgagtttcggcatcgaatcgcacagggtgcgtaaacgttaccagtctgcgtcggtgggtaaactcttggagggctctcagctcgggcgacatcattacaaacatgccaccgttcagatagatgattaccggtgagcccggttcgtagccagtgtcgttgtacgtgtacactttagagtctcggtactcgtgctcgacatactcggcgtctgatgcatcgctgtacaattgcgacggatagttgcgtatgataatgttggccaccaactgaggcttccacactagtaccgcaacgcacatgcacagtgttgtataaattataaaacttataacactgaaaatgctaatcatattgttgcaggattcaccgagtcccattaaagtatacaggtatcgattcagcaccaatacgctataccgacaaaatctacaaaactaacaatgtcgtttctcttgaatatggaacgtaaacggctcaaggagctcgtatccagagactacaacatgctactggataattcgactcattacaaaaatgtctacattcacactataggaatgagcctgagcgacaagcactatgagcagatactgtgcaatgattttccacgatccccgctcaagcactttacaatgtttacgagttccgagtacagcggtgcggtaccgttggtcattagcaaactggacggagtgtccgagacgtacaacgatgcccgaccctatctgtctgtgttttacacctttgcacccaaccagagcgagtgctatagtttgaacattgagagcaaatacgatccactgtgcaacgacatgaagctgtggtactaccgagactttggaagccgactgattctgtttagagaaaacgtgcacgactacaaggagctcatcgctaccggcacatggaaactggccaacggcggtcacagttcaatgatgagcggatgcggtggtggtggcaatagcagtataagcaacaacaatggacactattacttgggatctagtcaggtaccaaaaaaggcaaaggatgataggaccgagtctcaaacagaggctcctctgtctgagcctcggatagatttacaaacagacgttatggatgtagagaatcaacaacaggacaatgttcaaatagagacagaggtggagtcagactccaagtctaggtgtccgtttaatgcgatgccacacttgaacgatgtagtcaacgagtttaattacgattgtcaaaagtttataattttcatgagcatctcaaactgcaaagaagtgtatgatttcaagcacttgaaaaactttgccatcgactttggaggcaagattgtcattgatcaaaactatatcgaaacgtttgtaaatgctcctaggattacgtgaagtgtatacctacctagtgtgtttgattatatgttttaatttacaagtttatttttttgaataaagattcaagagtctaaaaaactaaaagttttattatttcttaaacatttaaatactttatttcttaaacatttaaatacaagcacatactctacctacctacactaaacataacattttctcactctacatgagcctcctcttcaacatgaaatgagtacacactggatgcctagcgcatcgagtctgtttggtctgaagcatgcgttgacacactttacagtttttacactttatacaattgatgaccgagtcggaggaagagtccacttttgatttaccgagtccacttgaaatcttgccaggctttagttttttgctaccgtgcaacagcatcgccaccgaacgattgtactgattcaccgagtccaacacgtcctcggtacagtacctcgaacgagtcttgatggatttcttcaaatcgttgagtgggccagtttcgaaatcgatgcactccaacgatacggtgcacattttgaattgttcacactccgagtctagacagcaaaacgatggctcgccaggtcccttgagcgagtacatgcgattcccgcactcggagcactttacgttttcgtatgcggtcaaccagatgcgcggacgatgcatcgattgcagcacaaatggtggagcatcgggatacaccttgggcgattcaatctcattgatgggcaagtaccgagtgcgcaaccatgaactcatcgagtttggtacgagttcaacgactccaaaaatgatacgaatcgagtctttgatgtcggaccagactccttgctcgtcctcgtgagtcctatagattgcataggcaaacgctacaatttcacgattgtgaatcatgtcgatgagcgagtcctcggtgacggtcaactctccaaacttgtacgagtctatactgtaccatttagtcttgttggtaaagagccacattgttagactctttggtagaatgagttttaaaatgtcaatattcacgagcggtggctccgagtctttgttttcattgttttgctcagccttgaactcggactctgctaaacacgtttcgattccattggtgtcgacaacgatattatcgttggccttggttgccgagttcaagtctacaagagaatccacctcttcgcacacgagtttgggatcgtagactcggtcaacctgtacgagtatatcgtaatcgttcatcgaaatgaccttcatcttgaaaaatctctaaaaaaacacaagcatcaatagaccgagttcccagacgtaacataaacctttcggtccttgggaatcgtacgcttgcatctcacggatcgttgagttaaacacgaaatcataataacaataacagtcatgattccaacgattcccacaaagtagctatgcagcgcaactccgtacggaccgatcgtcttgtttataaactctaaatacagcgaatcgtgatccattccgagtgtgcatttatatataatttcaataagcaataaccccaataccgtattgatattaaaggcatgagttcttacatagaaatgagggattcggaagctttggatttgtgacaattctggctacgtgctcataggcacgtacatcctgaattgaccttggtagttttccattttgataagatttgattttcaaaattcctttgtctgaaacagtatataaagagacaaattttctggtcagttcagtctactttacacacccggaccaggaacaagcagccaaaggaccagcccagagcctcagagggagccccaggagtcacagatgagtactcttttgaatcacttgttgttttgatttgtatttgatggactctttgattgtgtttgactcgttacatttgtggggactcggagtactcgttaactcggtgtgaatctgtaactcggtgggggatcgttacatttgtggggaatctttaactcggggactcgttacatttgtggagactcggtaactcggtatgaatcgttgactcggtggggaatctctttgactcagtggggctcgttaactcggtgtgaatcgtaacttgatggggactcttttagttggactctttgggtaaactcggtgggaatcgttgtttaaataaatgtagactcggtggactcggtggactcgttgggactcgcgaactctatgtaaactcggtggggactcttttgatagaatcgatggactcgtgtaatcgtaaactcgatggactcgtgtaatcgtaaactcgatggactcgtgtaattgtaaactcggtggactcgtgtaattgtaaactcggtggactcgtgtactcttaaactaatatggaatcgtttagtgtgactcggtggggctcgtgtactcttaaactatatggaattgtttagtgggactcgtgtactcttaaactatatggaatcgtttagtgtgactcggtgggactcgtgtactcttaaacattaaaaatattaaacttgtaatcttaaactcttaactcttttggtatagagactcgggactcgttgtttccaaatcaaactaaaccaaacttgaactcgttcgtttaaacttaaaccgagactcggtcaaggattcgggctttgatttaaattgtttaaactggatcatttagactcggtgtggctcggtataactaaatgggctctttgattcaaacttgaactcgggagttgaacttgaacctgcattgtaagctcggcggcgtgactaatctttataaaactctgtgtaatacgagtccaatattttgctttgcgctctacctactcttgtaacagttgacttctattgtgtatactatataatgctgcatattaaaactatatattaaactagctactatttaataatttgcataatatttaacaagttacactactatttaataatttacacattcctactacttactaacaagagttgtacataccatttaaaattattgaaaggttactggggcacttaaaggttgctgggatattttaaaggcatcatccacaagactataactcaactttaacaactgtaaaatctttaaccgtagaatccaattgtttgatttaaggggtactgaaaagttgagactggtttaaaccggtataaattagacttgatttaaatttggctagctagtcttgatttaaatggggtcttgaatgaatgctcgtaaagttggactgattggactatgctaattggacacttgcatatagagacatagaggggttgcataaattttgtaatgatgcaaatctataggttgaagcgcattctgtgcaatgtctcaatctacaagagttgatgtgccggtaacgatacaatgcgatgagtgagtaggtagttgatcgacatcacttcttgcatgtagtacgacccttgtagtaaccaagtattgtatctatttggcttcttttctatacacttgcttctctatgctttgcacactgtactaaataaaatgtgcgtgtatctattgcttaaactaacatttgacttggacatttggaatacctacctaaatttagagtacagcgttgacattcaagtgaagtgtgaaatatacaagtggacagtgcgtgtgtgtgattattattattgagtgtaaagtgtttatatattaaagacaatttcgattcagtgtttgcatattcgagtcagtgtactttgatgtaaacttttgatttaaactttggaattttaatatattctaaaatctaaaataattctaaacagtgaaacagtgcagtgaagtgtgaaatacaagtgaagtgtgaaatatacagtgaagtgtgaaataacaagtgacaagtgtgaacaagtgttttgaatgaatgtacagtttgtcaagtatactgaagcgtcagagtaaatgataaatgattaaatgtcaaataaatgcatcttaaatgcatctcttaggttgcactctgtaaccagggcggctcttgcaagttggcataagatcacaaatctctgccaccttcaatagtttgatcaaaggccggggctaggtactcggttgatggcattgtatggaagaatgtttgaacctaaaggattggctagtttaaagaatagcatactagatgtgaatataatttatagtataaaagaaggatatacttaaaaagaatagcaccacctgatgtgcataaatttagagtagcgttaatcaggtttgtgaaatttatgcatttgtcaagtttactggaagagcgctctataatttagaattatagttttatagaggctataaaatggtatgtgaaaattaaaaagcctgtgaaaaattaaatgcataaactgggagtgtgtatattaataacaaaagttatactgccataaactggaccacctagtaatgtaatgcacggaagtgggcatctattatacaactttacaagccaagagattctaaattggcacttgaagtatttgatagctttccagagttgaacaaggctgacggtaaagatgcctagattaaaccagcttgggcgtttaaaaataatttgctactaaaagtttaaactggcattaaattaaccaggcagtaaagtgggatacttggagtaaactgatggtaaaaccaactgacggtaaaactaaattgacattaaacagacactaatggtcttggctcttttagcggtagcatttatacatgcacatttcgtgtagtaagtatctagagtaatgtatgcatttacagacacatattgcttgttgacgggtaagttgctataataggataaattgctataataataacaccaagcctgctatcaaagaacattcatcataaacataaacatttaaccatgattaacaaccaaccatcaacatggccaatatttacatcattaaccaacatttacatcattaagcgtgtccatctaataagccataacttggcaagtaaatgattgaaacattaattggcagttatacactaaacctcattctaaagctcaatctaaaacctcatttagcttgattgataaacattattcctagccgctttatagaccatcattaaacctcatttactgattataatcgcaaaccattaacattaacaatgttggctcttggaatctctttatatgcatagattgaatcgctttataaatacgtgcagcagtgctttggttgggaatctttctgtacacttaatttgtgtgcttacagaaccatctagcggcatcggtcaaaacttgcacagagactggtgtattggtgcggtgaaggatgttttgagccgaggacaccttggatggtttactctgaggatgcttggattttggattttggattttggatttggtaaagtatgggaggatgtatggtaagatggtaagatggtaagacggtaagatggtttgttgtaaaaacatttaaaattatacaaaatataatttacaaaattacacaaggtgtgtatcgtttgattgtgttgaaatatactgatgggtagaatgtactaagagtgcaattaaatgtgtttcaggagactgagcagacaactgcacctatatactctaccttaacctgacgagggttggtaagtaatggcaagtgttggattggtaagtaatggtaagtgttggtaactgttggttttggtaagtattggtaagtattggtaaatggtggtttggtaagtattgtacagtggcaacttggtaagtatcatgtggtggtaagtatcatgtattggtaagtattggtatctatcaggtatgcatacttgtagtaaaactgttttaaataatgtgtctatatgtctataaccatgtgtaccactaatcaatgcattctctttcaggtttaatcaaacttatatgtttcagattcgagaactaataacaagtctctttgtttcagatgcactaatcaaaagtctctttgtttcagaatccttcatttgtaaagtattcaaatgaatttatacatgtattctgttgcaaactataagaattgtgttttaaactgtaagaagtctgttttaaactgtaagaattgtaacacaaacaaaagtataaaacagcctactgaaaaaccaaagcactcaaccatccaagtgtaatgctattgtactgtttcaggagcagaggacaaccctcttgcaaggtacagcatgctcaatttgcagctacaaggagcactctgtgagtatacaacctagacttgtaatataacagctaatgtaatttggtttcaatattgcaggtgctgtaattgacgcaaagtgatgtaaattgagcacggatattggacagctaccatacttggtgatttggtacgtatagaggtttagaggacttttaggttcaataaagagtttactacaacgccaacaacaacaacaagtgttttactgtttcccatcctattgtcccgtgttgtttaaatttgattaaaccttttataggttctcggaagtcatcttgtcagaagtgggattctacatgattggattctaaaggattaaactctacaaggagttgaacgtgcctacaatgcagtacaagcaatcacttgaaatgtgcatcatgcgctgtggaagtttaccaaagaattgaaaaataggaaatgaagaaaaaacaccccttcatctaggccattcgagataagaatacctgatatcgcacacctgaataaacaatccactgtgtggcataaacaaggctattgttttcgttttaatggccatattctaggaagcatattggttaccaagtgctgttgtcgagtgtctagaaacgtgatatgcgctgttgccatggaaattgatgctgtggtggtgctactttggattggaatgtctaggcacaagcattgttcaagataacgattggtgtttgctgcaactacttaatgtatagttttaagtattgttaaatgatgaaatgttgaaactatgtttgagagtgattggcatgtttgagacggacgagtatatttgagaatgattggtatgactaaagatgattggtatgactaaagaagattggtatgactgatgattggtatgactaaagatgattggtatgaattttacggcgcctagctataagttgactgcaacgtttagatgtaagatgatttgcggcttctagttttaaggatgcgttttagattttaaggattgaatagttttaaggatgcgtctagtctgtaagagtacggtctagttttaagtacacgcgttagttttaagaatacggcctagttttaagcacacgtattagcttttaagaatgaatacacattctagttttatttctagttgtaagtctacacaccaaatcaagagtcctttgattctagatttgagattgaactgtattggttcaatataagcacagtacattacactacactttacaaatcatcacaatcattacacaattcattgtacacaaattcatacatgcatttacacaaaacatgcattacacaagacattcattacacacaacattcattatacaaaatcatacattcatcacacaaaacattcattacacaaaacatcagtgtgtttggtttgtgcacactcttttttttgactactatctttgaatactacttactactaacctctactactaaccccaagtgtctaaccatttaaatgttgcagagtcacagtaaatgtctacacagaggtctacacagaggttcacacagaggtctacatagaggctgcattctacagtctacctatggcatccaatattccaatggttgctgcattcacacaacatctggattggtttggtatagtatgcaactggtttgtagtacatccatctctctagtatggtttgtataaatggacaatctagcttgtaagaataatgctaatgctagaatacaagggtacccaaatcataatgcaaaaaacatgtcttaatgttaaatgtttcagatgtgatgcagcgaaactccaaagctaacccttgtgtgtttcagatgcagtcgttctccatcaaaccatcaaaccatcaaaccatcaacaacaacaagtgcacctatataaagtgcacggcaaacttgtgcaatcgtacaggttgccgttacaggtatttgcatgcttttgaattttacatttaacaatgcttttgggttcctaaacctgtttaaacttgatgtgtttgttaaagttggaatgtgtgtacgtataaaccggtatgtggaaccagtttgggttcggaatgtggagcccgtctagcgtgttctgatgttaccaatttgagatgaatgttaccattttgagatgaatacaagggacgaatgtataaatgtataatgttggaattaattagaacttagactaagaatacttagactaagaatgtctattgaacatctgcagaatgtcttgaacatctattgtagtacatctactgtagcaatacatgtccgtatttgtatgtctatatttgtatctatctgtaattgtatctgtctgtaatttagtccaagtagaataagaaactctgaataggtacactctggattcaagaaagaagaacggtctcaatcggtatcggttacaaacgttgtttccatctataacggatctcggttataaacgttgattctatattctatctataaaggaactcggcatatgctactatgggactcgtatgggcatctaatgggtagactgaatgggtagcctgaatgggcagactgagacgcatcatttgactgactaaatccaacaacactcgactctttgacttgactcgacggtaccagactgtggtgccagactttcagacatcatatttccatactatttactcattcaaatcatctttatacatccacattcaaatcattctattcatcctctctctcaacatcaacatcaccctcgtagacctaagttttcatcacgtctacttttaaaataaaacacggactctacttgtaattaaatattaaataagctctatatacatatcgtctacatttgaggttataaaacgttgtatgcaaaattgaaaattgacactgttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaatttattatgcatgttaatttaagcgtttatttatagctttatacgttgaagatacattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgccttggatgcatcaaaagtgtaaaatttaaagagctagcggtaaaaatgataaaagtatacaaatgtacacttttaggacaaaccagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctcggttcttatcgcaacagagtggggccatccgcactataaaaagccgagactggtgacgaacaccatcagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacaagagacttgatggaacacttatatgtagaacagtactactactagaggatagcatttagtagaggtgctgggaacaatagtgtgccgagtataatcataggtatgtgttgcaatacttttttctttatgcttttacattttacgattcattacttgacactgattgatattttatacttgttgatattgtgtggataatttatgaccatctgtgggaatctaggtaggtagggttttatacatgcttacacatacacactgacactgacacacattttacaaacaaacaaaacaaaacaaaagtacattaaaacaaacggaaaaccaataccatacattctatcattctatccttctactactattactactaccactatctactatgggtacctaccaaacattttttaaaaacatttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggttcggttagatataaggctcggttagctataagtcggtgcggctagtttatataagtccggttagatttaagtacggctagtgtataagtcggtgtgagcacaaatcaatagatgtagtaagatgtgatgctttatgaattgaattttatgaattgatacacggacggtaaacaagagttgatttgtgtagtatacgtcttcttcttcctacttcctactattgtaaacaatataaaactaccaaatataaaaccaaacatttgtataaaataacaacacgggttgtacacatttacacatacacactatacacaccaatttagggttatgataatttaggacatttaggataatgacaaagtgtctctggtaaagactggtggtaagactggcaaatactggtatataaatgcaaggatacaactactgtaggtaggtactctgcaactattatactctggtatactcggcaaactttgtgtactctagtactctgataaagctatactctggtaaatattctggtagaactctgtactctgatatactctggtagacttttgtacatatacaactacaacaacaaatctggtaactcggtgactctgactctggcgtctcttggtaactctggtggtattggtattggttgataaaggtatcaacggtttcaaacaaaggtattggtatcaaataacggcatcaaaggtattacacaaaggtattaaacaaaggtattaaacaaaaggtacaaacaataggtttaggcaaatgcacacacataagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgcgatgcgatcgttaggctctgtgtacgagtatcgcatcgcacaacaacccactgaccaaccccctcgcaccgtcacgttgtctttcaggcagtctctcgtggcgtgtgcgcttgtttgctttgcaaagagattgccttagtgccttgttgcaaccatggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgacatttgttgtttcattttatacatcctgcatcctgctacaaccttttacacaaactgttaggtagagtgttttgttaggtagagtgttttgctacagttaggtagactgtactgtaggttgttgtgtgttaggtttgatgcaaacatacaaatatacaaatacataaaaccagagttaccactagggcttgagactataaagttgtgattgagtatagagttactctttgaagagtattggtattctgaggagtattggtagtctacaagtatcctgccctgcaccgagcaccgagtctacactgcactccgagctacactgcactccgagtctgcatctgcatctacaagctacgcacacgcatcctgtctgcctacatctacaagctacaagctacaatctacagcaccgagctccgagcaccgggtctcaccaaactaaacggtacacgcaacctctactgtggtatcccagagagtgttggagtggtgcctttagttacctaccataaaagagttgctagaactcagagtagacataggtagatccaagagtagagctagaactcagagtatagttaaacccaaagtagacagagtagatgcctagtatagataccagtatatgccagtctgtgtagctagcataggaggtagtaggtaaaggttttggtttggtaactggtttggtttggtaaagaggttatacacctacacaccattttacattcttaaaaaacaagaatgtacaatggtataaaataatataataaaataggtacctaatgtaaacttgcaatacaaagctaaccatgcaactattataaaactacaactaggtactaggcacctaattgtgatacaccataccaaaccttctatcattccatctgcatccatccatctatatatctacctcctctaataacaaaccaataccatccaacacccaatcttaccaaaaccaacaactcgccattagccaccctagggcacctgcacaattgcactcaaactctgatgttgctcagacagtacgcgtaggttgtagagtctcaaaaagtcgtcaaatgcaaactctttggttgggtgaatcttgtgcaagttcaccttgttgtgcaggtcatagattcgagtaactggatcgctagtcagtagcataggataggtgattaccatgatgggttctagtttgtcatagttttcctgacacatgccgcacactagaatcagactgagattgatgagaatgctcgcaaaggccaccagtagctctttgtcgttctgagccagaatactggtcaggtgcagaaagcgccaatacgtgtgaccccaccactctttgagcttttcaatatcaaccggatacaggccatagtggtcgatgacaaacttgtaaaactcggcagaagtgtctgcatcctgcttgatgcgcacaaagtactcggacaccttgtcaccatcaatcttgggtcgcttcaacagtacactgagcatatcgaaaaagtctcgtttgtagtcgcacaccaccagattgtacaagtcggtgggaatcagatgcaccacataccagagcatcttggcggcagagactcgaacctcggaagtcaaccgttccggatccatgcacgcgtagatgcaaactctgtacgtgccctccaagcgcttcggtgtacgctccttgtacagcgccagtgttgaatcttcgtcgtcgttggccatgttggggaatctaaaaaactagagtggttgatgggttgatgggttgatggattgatgtattggtacatgtatttgaagtatgtttctaaaaaataaaaacacttgtgtgtctaaaaaatgagccttttatttattaatataaaacctttacatgtactttaagataatacaagatactacaagatactccaagatattctaaaatactctaaatatttgatataggtacacatgtgtataaatacaggtacactacttaaatctaatggcaatacacatggtggttacaaacaactgccaagtaaattgtaggatagtaaattgtaggatacatttattctgaattcataccaacaccagccctaaacaggctaacttctgaaccatagtcagagtcggaagccaacgaactctgcgtagactcggaagtgatgctcgaacacgaactgcacaaacgacgacgacgcagtcttgaactagagcgcagcttggcacggtaatcattatttgggttgcttatgctggtgggtgcacttgcaggcggtaggatgacatccaccatgtcttgtcctgtaggggtggtagtaggtggcggcggaggtgtaggactacggctatcggcacaaccaccatctacactgttagacttgacgattccatcattggcactactactagacagtttacgataggcggcctcttcggtatagtctcggttaaagagtttgtttacgcgacgcaggcaacgattcgagatgccaccggttgctgttgttggtgttgttgccggttctacgctcttgcgcttagtgggcctaatcttgcacttggccatgtagcgttcctcgacacgcttcaagtcggccatcaactgttcggcaaagcgtctctcaaactcttgaacatcttcgacaccaaactctcgtcggatctcttcgtcaatcattctaagtttggcgtcttgcaactcggcctccttttgcaattgcaactcttgcagttcggcctcttgccgattgagctcctttaggcggtgctgttgtgccagctcgtgcatcggcctagtaccgcattcatcgaatccctctacgcatatgggatcgtgttcaaacgaatagctactgcggctacgcaccagattggacacggccgctatgggtctcttgaagagtcccatcagtgcactcaataggttgttgtttgagcgattcatagtgtacaagagcaagttggaaatttacaatctgtaggtacaaggtgtacagtacaaggtacaatacaatacaaggtatgcaatacaaggtatacaatacaagatgcaatacaagtattggtatcttgcaatcctctatagtattattagcagtggaagtagcctatatatatttattaaagctttaggtaatactagtagcctctgtgaatagtgcaacagtccaagtacaaataccatattgcggtaaagctgcaccagttttataccatgttgtggagaaaatgtagtaataaatgttacactttgaagggattaatccggtccgttatccactgccacacattaaaggcaatgttggcgtacgatacactgactagtgcaacgctcagcaggagcatcaagactccgagtaggtagactcgtaaaactatcaacacgacaccgataccgacagcgatgcccgtgtaccgatttatagtgtcaaaggcctgtctgcgtagcttgtgatgagactcgtacacttcaaagtcttgcactgtaaacagtttggctcgcgttagaatcttttcaaactctatcgagcccacatcgatcacgttacccttgttgattcgagctccgtccgagttgacttctagggcgtccaagtagcgatacgtgtatgtgtacgattctatgctggcatcgaacaaatcctcctcggtcaataggaacgagcacacgtagtcgaacgtcagcaccggtcgattggtcttgagctgagagcgcaacgccatctttgagttttcgtacagctggtgcaggtagtcgggcgtgtacatgttgttgaaacccaacggatcccagaacgtgagcagtatgctaaagagttgcgttatcagcaagactacacccacaccggtcgaggccatggccagactcttggtcaggtagacaccgatcgtgcccagactgcgcaccgtcagcggtaccaccaagtctcgtacggccactttgaacgatgcacccaacactagttccgaggtgtcgatggccatcgtggcgaccttcttttgtagcaacggcaccagtttttgaatcgccttaaccgtcatcgtctttagctgactggccagttgagtgacgcccacgtctacagcaacgctggcggcaaagtctgcgctggtcagttcgttgagcagcgacagtatgatcgattcaaacttggtctgtttgccagtctgcgaggctagggcatttttgagttcacgatccgcacccgatgtatcgttgaggctcttgactagatttaagagtttttcaatgtcttgatttttggtagtactagtactagtactagtactaggcttggtaggctttggtttagatttcatcatagcatcatcaaatcgtacaattttaacattgtcagccattggtatagtgttgggactcctcttgcttctgtggttcactcggttcattgtttccaaatcgctcacggtcacatctatgggcggtagtttaaaattgggatcgatgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgctagtctctgaccaacggtagcgaacgttgtgtggcttgtcggtaccgtcatcggtgtgcacggccgtttcgaacaagtggaagcaggccggattgcattgaacctcaaagttttcactctcacccaatctatagtagctggccgcatccgtctttttgcagggtccgtgcacaccggacgagttgcacgaaatgctctcgcacaattgttttgtaatctctgcctctacgaatatggcctcggaggccattgccggtggaatgtaataatcggcatcggtggccgctctgacgttgactttcaagtgcgacgccaagaagggatacttttcgttgagcttgtgcagtagcatcaagagtttacgatggtacgaaaacttggaggcatttgcaatgtctaattgggtgtaggttgtggtggtagtggtagtggtagtagggtttgttggtgttgtaggattaggattagggttaaggttagtaggtacagtagacattgttggttgtgtggattcattaacctagcatatacatacacacaaacgtgatatttatacaaagatttatacctaatatttattaagtactcgataagtacaaagattcaagtacctagtactactatggggaacgtgcacacacagactctctcttccttttgaaggaatttaaactttttgtacaataaaattaacaagcaagattaatatgcaaatagcaataacgtgcaggttaatatgcaaattttaatgaggagttcaacttatgagacttttatgacaatatcaagttttgtaaataaaaggttattttcaactgcaacaatgtgtgatgcaaatttgagtttgtacagagtagctctattaaaaaagaatactgcaagcgttgttcattttatacacaacttgtcatatacgagtactagtaacactactagtaccactactacaactagtacaactagtactacaacccatcatagaggtttaccaattcttgtaatctttcaatcttgtaatataaactaaaactaaatattcttacattaccaattctctttacaataccaattcttacaataccaatcatcattatacaataccaattcttacaataccaattcttacaataccaatcatccttacaattattacaactgccaattatagctctatgtagctctaccaccagctactacagtctacactctacacgctctactacatgatccagtacatgctccactctacacactacggcactcggcacgctccactcgacacactctactctacatactcttatcctaatactcttacaaatatttaaacaacaaataacaagcaatagcaacaacataggcggactttaagactttactgtaaactaggatgttcagactactttgataaactaggactttaaaacaaattgatacattataataaaagtacaacaaaagtacaacaacccactacctcccttcaaacaccaaatcccttggatctttacaagtactttaaatttccaaacattttagatccatgattaaagtacaagtctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagccgcaaccgcttcaagtgtccgattacgtgaccggggtctccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtacagcttgataatgtgagagatgagcgcttcgctagtgggaaactcttcgccgtttacatagtctacgtacaagttttgctggatcaggtagtcgacgttttcaaagtagactagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgccggttagtacatgttcaaacgactgggaccgcctccggtgggcgcctcggtacgcatgggcacaatgtccagaaagggtggcaacttgagattttgagccaaggcttcgcgattcatgaccgtctgcaaattgaccagattcgatacgataccgttcagagtgctgtgcggtagcatctgcaccgaggcactcctcggcgtatattgaaactggtaaacgtttgcgttggccaacatgtttacctgttcggtggacttgcgcactagatcgttaaagacggtaacgtaggcgccctcctcgggcttgtacgaactctttacgttgaccctgcacgttgtgggattcatagtgttggtgatgggctgttccactttgctccggagccagaaaaagatgctattcttaaagtgggcaaagtttttgttcttgtacgcactgaccgcctttaggtactcgcacagtatactctgcaggtgaacgtactgctcgtcaccgggcgtactgttggcaaagctctcaaaggcgggcagtgtcatgatttttgaaaaacacttggcaaactcgccgacggtaaaggttcgcttcgtaccgatggtggtgacggcgtccaccacatcgggactcatgtagttgcgattggccttgtaaatgtttttcaacgtctcgggatcggcgacgccactctttataaactcttcaaagagttgcttggtgcgatcctgttcctcaaacatgattgcgatacactttgtatacgatcggtgtacatagcatctacattattatgcaaatttcctgatagatgcaatagtctattgatcatcagatggtcggaaactttgacaaggagctatcggtgcacaatgcgcaaatatattcacctgttgcagagcaacaaaaacagtaaagtgtacagcgtcgaagacctggacggtacactttacgtgatgaagattataaaaaatcccagtacactggtagagattgaggtgccctacaaactcaagcgtctaacgccctgggtcatggtaccgtaccgggtaaactttaaaaaggacaaactagtcatctactctagctatatggagaacaaggacctgactcacaatgtgacatcgatgagttgccagtccaagctaagggctctgctcaatgtggccgaagtgattcagtgcatgcactccaaattaaagtgtatgcacaacgacattaagcctgaaaacattttcatcgatcgctacaagaatgccaagctgggcgactttggcctgtgtcggtacaaggtacaaaactgcaccgctctaatgggcacatcccgatacatgtcccccgagaagttgtcgtcttcgtacgattaccgttcagatatatggtcatttggagtgactgcttattactgttttacgaacggggccctaccgtttcgcatatcggacaattgtgaggatgctcgcaaagtcaactggaccatgcatacggaccctctgaaggtggtctttgatcaagatttacgagaattgatagtcgagatgttgacgtacgacattagccggaggttgaccaatttgagtgagattatagagaggttaaagatggtttataaaaagtttgaaaattatgttagttagagggggtgtagagggtagctgtggatgtgtatgtagatgtaggtagatgtagacgtagactcggcagcgagatttggttgtattagttgcatttatacatggtatttattaacaactatattaactaacttgtgtatattttgtatatatatatattttgtatcaacctagttgtacaattgtcattaggtacctattttttagacactcataaatgtcaaactttgtactctttaaactctttaaaggttcccctctaaagctaaacaaacccaagatgctaaccatcaatataacgtatccaccgaggcccaagattccgataaacctcatcgtggccgtgtgtgaaaacaacatgggcatcggtatgaacaactcactaccctggcacttgaagcgtgaaatggcacactttaccaagaccaccacgacggcaacgcaccccaacaagaacgcagtcataatgggccgattgacttgggagagtataccgaaacgattcaggccgctacccggtcgggtaaacattgtgctgaccaccaagcaccgaggcgactacgatggagccacgcgagtgtcaaactttgacgaagccatcagagtcgtcgagtctcgtggtgacattgagaccgcctgggtaattggaggagcgtccgtgtacgcagcggcaatgacccatcccaattgtcaccaaatacacttgactgcgatcaaaaagtattacgagtgcaacgtctttttccccaagattgatacgactcgattcgagctaatctctgaaacgccgtgtacgcgcgaaggcgacgttcaatattcctacaaagtttatcaacaacgaaacacacacgcttccatctaatatgtgcgtgccgcgataacgtcaatacgctattgttgttatatgtgagcagtagtattgtagttcaacgctttttgtgcaagtttcaagtttcttttagatgcctcgaactttgttgcattctgaagtggacgcagtcagttggtgtattgttgaatatgaaattgtggaatatgagatttatgaaattgttgaatacgagattgtttgaaagtaggtttattttccaagtttaggattcagagcaccctttgtgtgtctattataatatacatgtatatacaattgttgttaatcattctttataggatgaaaaggtgtattgtgtatagtagtaggtagtaggtagtaggcaatggggtagtgtgttgtaaaataaattgcttagaataaattactaggaactgcaattaggtgcaattagaatatgagggtttaatttaatttagttttttaaagaaatcatcacttgtgttgattgtcataaatggcaaccacacacactcttggaaaaaagagggtgcacttgcagatcgtaaaagttgcaataaatttcatcaacctaatcccttgcacatgtagtagggtgctcttttatggtaatatgcaaaacacatgggatctaggtttgatgcgttgacatttattacaacagtctgagatccttgaaaaatccaatacaaaaaagtatcgtaaattatcgatggcgtgtgacgtaacctcttgcgggttttatagcttttctcgaaactctgtcccgagactgggtttatggtttttgtgtggttttttgtgagctacatgtatagctgggcacagctcactcttctggatgtcataaaacttaaagtttacgatgcccactttatatttattgcaaaaaacttggtattgtaggaaacaaggacaccgataagggaaagatgcaggttgccatcgtaaagacttatcatggaaatcaaattgtttccaccggtataattgtgctttcatttaatacacgctagacaaaggatgttttaaaattagtttttaaaagaatcaaaggaaaagttgcaaagttgtacacaaagcgcatcctcaaactgccaacagcatctaccacccatagtctagatttttaattgggtttcgtaactattataaaaacgctttgtgtaatgtaaaagtgtccgagtcagagtgctaggaacctttaagagaggagagaaactcaatttacagtaaaatgcagtttagcactagaatggcctgaaacgctatgctacagttttcaaaacacacgcacacacatcaaaagactttgtagtgtgagagaaatgaaaaaaaccataccagccagggcagcatgtatataaacggagcagtcttatcgcatggtttcagttaggcgcgttcttttgatcgataaatgtcagattttagtttagttatggtttttgactgaaaacatagactgattgtattatgccatggtttatcaacagatgttagtacgagtaggtaccagtatattggtaatcaaaatatttcatacacgtgtaaggctctagcaacaacaataacaaagggcagataagggggttgccacaatacgcatgataggaaatgcatagattagtcacggaagttcctctgtacgtgcaacaacaaagtggtgcattactgtaattagcgataattatggtaaccacaattatgaaactacaatgcattgattcataatacaccccttatcaccagtggtgtagattatattgtattataaattagttcatgactaggttagtcgcttcagtcaatcgcaaagcttcttatggtcaacttccggcgtagggtttgtgtgctcctgtttgtgcgagtattcagttgagctcctccctctctgctaatgtgacaagtgctctctctcttggacagtgtgtgtgtttatttacaaacaatgaaaaactctatagtttaatgacttgattttcgattcgtgcatcaaaggtgtactattagtttcaaaggtgtacacaaaaaaaatagtgtaaaacaatggtgtgctacgcggacacaatggactctaccgatgcgtttgatgcaccctctccggtgcagaaagagtttagcctggtcgaatacattctcgatgaggccgaggaacgtcgccgactcaatcgagagtgccgaagctatcgtgaattcaaacgtaggctaaagaatttgaaacatcagcgcgaagccagacgtcaaagctttgactcttcgcgcgattctacaaccaacgttagtatcgttaccaatacgagcacttctacggctgctaatgatgatgatgatactgttgctacggctactactgctacacatggtgatatcgaggctgctagaaatgtggctgctacaacaacaacaacaaaatcaaaatcaagaccaaagtcaagatcaagatcaaaatcaataccaataccaatgctagtaccaatgacaacaactgcaaatgcaattgctacaactgtaaatgcaactttaacttcaacttcaacaacaacaaacggactccttaaacccctcaagattaagacgaagcgaccccacattgaagactcggatactgacgatgccgactacgcaccaccagtcaattacggtaaacgtcgacgagtctctatgtctagtgtgcctagtgtgccttctaatgccaatactaacagtaacagcaacaacagcaacaacaacaatagtagtattagtattcacaatggtgttaaaagtaatgctaaaagtaatactaaaagtaatggcactaatgtcaactctgtgcatccaccacccaataccactcttgctaacccttgtaaaattcaagcacccaccaagaatctagacaagattcgcgaacagcgcaaacacgatagataccgtaagcgtgatcgcaaacgcaaagcggagcccattgtagactttgatggggctgtcaataaattgatcaagagtgaactcaatgttgatgtggaggtgatgccaccgcccagtattaaaccgcgcaggaaaaaggccaaggctacgtgcaagtattgtcgaaaggtaatctctaaccgttccaatctgctgcgacacgtaagggatgtgcacaagaaggacactagccggtacgatagtcagtgttcctctagcgcagaggatttgattcagagcgataataacaacaatttcagcagcaacctaaagagggctatgcttcatggaaaacccaacaaaccggcagctgttgagaatatagtcatagagtgcacaccctttgacgatggcatgatgtacaaacactttatggcagattcggacgacttggaggatgaggtggtagagaaggagcccgactattataatgtcaaaactccagacttgtttcacgatgaaaagatgaacattccaaagctgactagtgctcaaatacacggacccagaggcaacggtgtagacaatggtatagtctacataaaggccgattcctatgccgccagtattaacttgttcaactgtcagggtattaaacgtaaggataagggtactagtgttaagaatactgcaagtaaggatactacaagtaaggatattacaagtaaggctgttacaaataagtctattacaaataaggatacaattaaggatataaacaagactaatgatgccagtataactaaaagtacaaatgtaaacaatagtgtaaatagttcaagtttaaatgaagaggacgaatctcatcaatctatgcctgaatattcaaaccctgaatattcacaacctgaatattcaaaccatttaaatgataatgtaaatgaagatgtacatgtaaatgaagatgtaaataagagtgtaaatataggtgaagagtgtaatgataatggaaatgagcaaagtgatgtggagcaggtcgacgaactggatacaatcaataatgtagacggtggtgtggaatctaatgtagagatggagtccaatgtagagatggaatcaaatgtagatgaggttgaacaggaaaattcacaagaggtgtcacaagaggaggtaacgcaagacgagtctcaaaatgaggccaacgaggaggccaacgaggatgatcaatctcagaacgaggaacatgacacaattgatgatgatgaacagccagaggatcaacaagaatgcaccgaggagcaagaacatactgaggaacaacaagaatgcaccgaggaacaagaacactctgaggccgagcccgaagaaggctccgactccgagtctgaatctggctccgaatctggttcgggctctagttcaagctctgactccgactctgaatcaaactcggacgccgaatccaacgctgaatcggaggatgaggacaatgcatccgagcaaccgactgaagccaaagtagaggttagtggtgtggatagagtcaatgatgataccgaagagtgtgttgttgtagagagtgtacagccagaggaggtggccatacaggagatggctgaaattgaattacccaatctagaattggaacatgaattggatgactttccagagccagagggtgctctgagttccgacgacttggaaccgaaacgtgtagacttgcagtgtgagcttgacgagctaatgaacgaccacgtggcattttccaaagattccacaatagaggcctttaacaaaattgatgaattgttatcgacaattcaaccattaccaatgagtacaatggaaccattagctgacgatgatgttaatgaggacttaaacagtcttgcaaataccatttctaatgcattaatccctaatgggtgcaatgtaatctccaatggaatgcagccccttgttgactcaggttggtatttgcacttttgtgtttactacacgctctctctctctctacactatactgcacactatactgctacaactacctgatttactacctggtctactacctgatctatacctgatctatacactacacacatatacatttataaatacatttataaatacatgtacaactttacaataccagacggaatctacactactgaatctaacactacactactgaatctacactgtaccaattcatctacactgctacactgtactactttttacgtccacctataccaacatttacttgtaataacaacatttacttgtacgtacctataacaccatttacttgtataaatctcatctcgttttttagactgtgcattttgtgtacctacattgaaaatgtcctacattgaaaatatcctacattaaactgtgtctaccattgtatgtgtatgtaacctaaaactgtactcatcaccctccattctcatccatttcagattgtaaaaacatcactggtgcgggcaacggctacaactatattgtgcatccccataacaccaacaatctcatcagcaaccccatcatcagcagtgtcaataatccatcgaccatcatatcctccttcggaatgaaatcatctgaaagcgtgccaatcaactctgcgggtgactctatcaatctgtatacacttgcatgcgtagcggataatgttcagtacaatagtaatactaataatagtagtagtgctagcactagcaacatcaatggtgcatctttgcctccgtgcggtaccctaagacgcgctcaggatactgcaaccagtgtcttgatatttgattgtaagaatgtaacttttgaaccgagcaacaataccttttatccaaccggtcccaatctgttgaccaatactgaatctgagcttgagctagaggaagagtctagcgtatcgggtattgccgacttttcaatgtacattcgcgatatgcaaaacgatgacccgctcttgtcaccgatgctgtcctccaacggttcagagaaacagctagagcaagacttgatggtgaccacaaatgacttgaatggtaactgtaatttgactgacaactcgactggcaacaactttgaagatgctccaatggacattgatggggcaagtgtaggtactttacagactactctagagacggtagaaacattacagaccaagactgtagaaacattacagacgacgactgttgcaaagatggacgagactgagactgtaggtaacgatactgttgtaaatgtaggcaatgattcaatacctgcaaccatacccgaacccaatcatcctaatcctttacccgaagctggggtcaatgttgaaactaacaatggcggtaatggtacggtgtctactaataaaactaatgatactaacagtactaatattaacaatactaacactactaacagtgctaacagtactaacagtactactaacactactaacagtaatgatattgaggggactaacaccaacattgatgccaatactgctacaactaatacaaacaccaacaaccacaacaacaccaaaccctcctcccccatccatcgcagtgtattgaatcaattcaaaaaagtcattgaacgcaactcgggctggtccaatctggacgagctactgttcatggccgactatatagagcccacgtccaaagtgtacatgatgcacaactttaaaaagcttaccactctacaagattcggtatcggacattgaaaacttgatacgcaccgaagtcaaacagtccatctcaaagaccaccctggactatttgaccgcggtggtcgtgcactacattcaaacgtttgcagcctctatgattatgtgcaatctgagaatgggtaggaagacggtgtcgagtgcatcctattgcaattttgccgagtacactcgcgacttgacgatgagtactcaagagatgcttctattggaattgtccacgtccggtgtgctgctaaacttgccaactgtagaatctataatcttgaagggttttatgcatgcgttgcctcatcaacacttggacgcgaacagtatcgaacacgaaactggtattctaaagatgctctacaacattgacttgactgacgagtttttacaagttattcgttcctacgccattaaactgatcaagtctatgggctttatgctcaagcgcgaaaacttgacgcagatagatttgtgtcaattgagcgacaccctaaagcgacactctaacgtgttcaaactcagatcatttctcaactttgatatgcatcctagtttgtgacttttaccattaaactttgtgtactttgaaatgtgattttgtgaaatgtagaatgtgattttgtataacttgtaatgtgattttatgaaaagacttgccaaaattgtaaattgagatttacattttcaaaaagtgtaaatgtcgatatcg

SEQ ID NO: 2 - DNA, 228089 bp, Helicoverpa zea nudivirus 1
  source 1..228089: mol_type = genomic DNA
tcgagacttgctcctgccctgttctacactgcactgtggtgctactctaccggttgctctgagcgactcgtactctggtgtgcacttttaccagtaaagtaaccaggtgactttaaaattacacatctctgaactctgcctgctgtgttggtgtggtgtatgctggtgtagtgtttgctggtatagtgtttgctggtgttgtttgctagtggcgtatactggtgttctgcggctgctgtatactagactagtgttttttgtagtatagagttagagttggtttgcattttagttttactttgcatcttagttttactttgcatcttagatttattttgcatgttattgtattttaggacttgcattatagtttgaattgtagttttagttgcatcccagttactcttgttatttaactctattttattattgtattactttactactctatccatttatattttgtattcttttgtgtactcttttcatttactcttagtgtactgcaattgtaaatttactcttattgtttatttactcttagtgtactgtaattgtaacaactggtgttagtagaagttgtaacaactagtgttagtagaagtagaagcttgtaagcatgaatcctaccggtaaaagtccccgttctaaaactaatccccagtactatcaacaacccgagtttgcatacaacaacttgatgtatccaaacacttatcccaacggctatgggtacaatttcaatccaatgatgcccgacactgccaccatctttcctggtactacaatctttcccattccaaccaccaatactaacatggctcatgaactcggtaatactgctgctcccaacattacgatgcatgacttgggctttgaaattcccgtgtttgatgttgccaataacaatcaagcagacatgtcaaacaatccatcatcttttgtttatagagacacgctaaacactccgactcccgacatgcaacatgcaatggaactcgaagaggacaagcttaaatttatgaggacctttttaaactttaaagatacccctagggcggctccatctatcggcaaacgtataaacgcggacggcactcctaaacgtagcggtatcgaaaccgatgacgaggaccaatgtgtagattacagcaattataataataataacaataacaacaagactacgtacacttccatattagacgacaatagtgtcatgactactgtagtaggtaaacgcccgcgtgcgcaggagaagggagaggcgctaaattcagtacgtgtcgagttcccgcgcaaagaggttataaattcaggtcaaggcaacacagaactagaaattggtttattaaacactcaatacgagatcgttgacgtgtccaaaatgcagagtcgtaaacgtacacatgaaaaggagaatatcggcggcggtaaagtgttacgtagtggttcggccggcatcaagactatggttacgcgctctactaccgcagcagagtcggcaggtaatacattcaccattgccaatactagtagcgctagcgcaactgctaccactgctagtagcggtagtgtttcatcttttaacactcgtccattaaacgcacacaacaacattgttacagttaaaccggtagtagatcaggccaagtctgcagctcaggatgcgactgtgatcaaacccattattcaaaataaaccatctgaatacagacacaaaaagtatgtcaagtttgatcacactgcaaacaagggctatcagacttacgacactgcggccaatagcgtagagtctaatgcgcaatttgactcgggtgtagaatcgatcgcgtccaacgctgctatggagattgacgatgtaaacggttcggtggaatctgtaacaactgtcaatgtaaatgcaactagtgtagtagagtccaacaacaatgtaaatgctgcaacaaaagaatatgcagcatcgaatgcatcatctaatacatccatgtccaatgtaccaatcaacttgtcaaacattggctctgatgtagaacgctcaatggaaaatttgcacaaagaggttgagaaggattctgtaggaaatgtaggtgctagtgtaaactctaacccacccaatgcgtccgaatcaaactctgagactgcccctaaaccactgattgctcgtaaacagattaactccactcaatccaaatcaccggcaccagagtcggattcggacagcagcgatgaagagagcagtggtagcgaggatagtggtagtagcgacaatgatagtagtggtagctcggactctgaggatgaagagccatccaatgcaaaggagccatccaatcccaaaacgacaaaatccaactctactgttgttgcttcttctgttgaaaacaccaaacctacacccaagtctcctaaacctgatcctaaacaaattactactattcctaaacctattgctcctaaacaatctgctgcaaaacccaaacccaaacccaaaccgaaacccaacccgaaatccaaacctccgaccaacactccaaccaacactccaaatcaaaatgttaccattatttttaaacaacccaccactcctagagtagactctaacggtatccctataccaaccgttccattgccgtacaagaccatatccaattctaaatccaaacgctccaagaaatacaagtccaaagagttcatttctgacgatcaagactcggacactgaaacaaccgaaaccgtttccaagtctaaatctggtcccaaacctaaacctaaaactgatgccgccaagtctaaatctaaagtaaactctgcacccaaacccaagcccagttccaaacctaaagcaactccctctacatttacaccaagccctgctccatcaacctttgaatccaacactgagccatctgcacctacacctacacctcctacaacaaacattgaaccatctacacctacaacaaacattgaaccatccacacctataacaaatagtcctgcaccatcaacctctgaatccaacactgcaccatctacacctacaagaaacactgaaccatctacacccaatgccaacaactcaaactctgtacccgaatccccagctcccaaaaccccggcctctccatacaaatcaccatccaccgatgatgtcgccaagtccaaaattgacaagagggaacaacagcgtaaatacctttttgtaaaggctcccgccaatgtgcccacagttagaactctgcccattgccaccaaggtgccgcgtattcataaaatctctagtgaagccggtggcggtagtagaattgccgccatgcgtgcagagcgtcttaaaaagtctcaaagtatcaactttataaacaagaatattatcagacgttttgctgaacgattgggcatagatagaatctcaaaggatgtctatccagagctgagtagaatcatagagtttttcatgaaggaggtaaagcgtcgtgtgactctgttggtagagtgcggtaagcgcaagactgtagagattcgtgacattaaatctattctaaagtctgtaggtttgcgtgtattggcagacgattacgattacgagggtagggatcctggtagtgcaaaagatgaaaagtttgatgtggcatacatgattaaattgatcaagtccaaatcgtgtaaaatgcaattcataccgactttgcctttttgtcgtgcctggaagaatatcgaaattcagatcgactcttaccaagttgtgcatctccgatacaggggccaggctctgttgttgatgcgagacgtgaccgagtgctatctggctcggttattggaggcggcctatattgtaatgttaaactcgggtcgtaaaactttaatggccaaagatttcaagagcatgattggtgtaaagatgaccgacacggtcaacctttaccacgccatgtttgactcgttgtatacatgagtagattattgttttttgatttatgttttatgtttggaggaactttggttctatttagttgttctttttgtactcttttgtattttgtactctttttatatttttgtaaccttttgtatttttgtactcttttatattacctacctacctactcttttaatactctttttttgtacttttgtattctttgtatagaggattatttagacattatatttagactttatatttaaaccttgtatttagatgtaataaagaatctatatttagatgaactaaaccttttattaaagacacttattatttaaagacacactcttgtacaccattccatttatactaaatgtacccgttattttacaagtgtaattttaatcatgttttacattttatttcaaaccataaatgtacactgtataataaacccctataaacaaacctcaataaatgcatgtgtaaactgtatccttggtattttactgattcctataaaccttgatccctacttgtgtttgtttacattttttgccagagtgccttcactctaaaatcatgatgtcaaacaaatcatgatttgcctagttagggatgtaggctaccattagatggtagtgctaggagtagtgctagcaaagagtctcgctatgcagattcaatacatacagccctataccgattcaatgcatacaaccaagtacagtccatacagtcaagtacaattcatcaagtgtatacagtcaacatagagattgatacactacctaaagatgacagacacactgttttgatgacacacaatgtttatataataaattcatttggtatcgccaccagtggtatcaccaccagtcaaccatcatataaacaaactagcatataaacaaactatcgtataaactatcatataaacaatatacacacgcttcctctatggagagtgcccaactagtactgagaagtacttgtgaagagtacctatgaaaagtgtgtatggcgagacttggtataaacaacgatgtaaattataaacaaaggcaactgccaactatacaactctaaacaaaacccgagaactgagactgagatctgagacctgagcaatttgcctgaggtttgaccttagagtgagagagggattaaagtgggtaggtagtattattatggcaatatgtgcgagttcaatgaaagacggcaattgacactttagccaagtgaatggtagtctgggaggcaatctggtaatgggttgcttgaatgattggatacaatgattggatacaatgattggatactttaaatgatacaagtctgattgattattgtaaacactttttattatcttgttgatatttcatcttgttgatatttgacatttgtatataactctactaggtatttaaatctaaatataaagtcaactttaaaatactaatataaacttgactctaaaatactctaaaaatactctaaaatacatttctataaaatagatgggcaagtatagtctttttcataggtggcacacaattcttaaatctacttcaatacctagtaacttttcaatagtaactttacttcaacagtaactcttaaacaataactcttcaacaaaactcttaaacactacctcttcaacagtaactttataatttaaactaaatcaatagttgaatctaactagcatactggccaactagaatactaaacaactagcatactaaacagctaacatactgaacaactagaataccaaccaactagcgtactattacattacttatcacttactacttactaggtaggtacctactacctactacatactacttacatctaaataaccatactcggttcaatcctaacactaatacatttgtactgtacacttgtgacattcacttgtgacattagtttcacttgtgatattagtttgacattcacttgtgacattggtttcacttgtgacaagaatagtatctaaatcgagtatcttaacgtctaaagtaaagcccaaaagtaaagcccaaagtacaaaactagacacggtaatggcaccattttaaggcatacaagtttgcagtctttgagatgcaaattgacattttagagcaccgatatcgacatttacactttttgaaaatgtaaatctcaatttacaagtttggcaagtcttttcataaaatcacattacaagttatacaaaatcacattctacatttcacaaaatcacatttcaaagtacacaaagtttaatggtaaaagtcacaaactaggatgcatatcaaagttgagaaatgatctgagcttgaacacgttagagtgtcgctttagggtgtcactcaattgacacaaatctatctgcgtcaagttttcgcgcttgagcataaagcccatagacttgatcagtttaatggcgtaggaacgaataacttgtaaaaactcgtcagtcaagtcaatgttgtagagcatctttagaataccagtttcgtgttcgatactgttcgcgtccaagtgttgatgaggcaacgcatgcataaaacccttcaagattatagattctacagttggcaagtttagcaacacaccggacgtggacaattccaatagaagcatctcttgagtgctcatcgtcaagtcgcgagtgtactcggcaaaattgcaataggatgcactcgacaccgtcttcctacccattctcagattgcacataatcatagaggctgcaaacgtttgaatatagtgcacgaccaccgcggtcaaatagtccagggtggtctttgagatggactgtttgacttcggtgcgtatcaagttttcaatgtccgataccgaatcttgtagagtggtaagctttttaaagttgtgcatcatgtacactttggacgtgggctctatatagtcggccatgaacagtagctcgtccagattggaccagcccgagttgtgttcaatgacttttttgaattgattcaatacactgcgatggatgggggaggatggtttggtgttggtgttgttgtggttgttggtgttgttggtgtttgtattagttgtagcagaattggtatcaatgttggtgttagtcccctcaatatcattactgttagtagtgttagtagtagtattattagtagtgttagtattgttagcattgttagtattagtactgttagtatcattagttttattagtagacaccgtaccattaccaccattgttagtttcaacattgaccccagcttcgggtaaaggattagaatgattgggttcgggtatggttgcaggtattgaatcactgcctacatctacaacagtatcgttacctacagtctcagtctcgtccatctttgcaacagtcgccgtctgtaatggttctacagtattggtctgtaatgtttctaccgtctctagagtagtctgtaaagtacctacacttgccccatcaatgtccattggggcatcgtcaaagttgttgccagtcgagttgtcagtcaaattacagttaccgttcaagtcatccacagtggtcgtggtcaccatcaagtcttgctctagctgtttctctgaaccgttggaggacagcatcggtgacaagagcgggtcatcgttttgcatatcgcgaatgtacattgaaaagtcggcaatacccgatacgctagactcttcctctagctcaagctcagattcagtattggtcaacagattgggaccggttggataaaaggtattgttgctcggttcaaaagttacattcttacaatcaaatatcaagacactggttgcagcatcctgagcgcgtcttagggtgccgcacggaggcaaagatgcaccattgatgttgctagtgctactactattattattagtattactattgtactgaacattatccgctacgcatgcaagtgtatacagattgatagagtcacccgcagagttgattggcacgctttcagatgatttcattccgaaggaggatatgatggtcgatggattattgacactgctgatgatggggttgctgatgagattgttggtgttatggggatgcacaatatagttgtagccgttgcccgcaccagtgatgtttttacaatctgaaatggatgagaatggagggtgatgagtacagttttaggttatatacacatacaatggtagacacagtttaatgtaggatattttcaatgtaggacattttcaatgtaggacattttcaatgtaggtacacaaaatgcacagtctaaaaaacgagatgagatttatacaagtaaatgttattattacaagtaaatggtgttataggtacatacaagtaaatgttataggtgggtgtaaaagtggtacagtgtagcagtgtagaagtatagattcagtagtgtagtgtagattccgtctggtattgtaaagttgtacatgtatttataaatgtatgcgtgtgtagtgtatagatcaggtatagatcaggtatagatcaggtagtggatcaggtagtaaatcaggtagttgtagcagtatagtgtgcagtatagtgtagagagagcgtgtagtaaacacaaaagtgcaaataccaacctgagtcaacaaggggctgcattccattggagattacattgcacccattagggattaatgcattagaaatggtatttgcaagactgtttaaatcctcattaacatcatcgtcagctaatggttccattgtattcattggtaatggttgaattgtcgataacaattcatcaattttgttaaaggcctctattgtggaatctttggaaaatgccacgtggtcgttcattagctcgtcaatctcacactgcaaatctacacgtttcggttccaagtcgtcggaactcagagcaccctctggctctggaaagtcatccaattcatgttccaattctagattgggtaattcaatttcaaccatctcctgtatggccacctcctctggctgtacactctctacaacaacacactcttcgacatcatcattgacgctgtccacaccactaacctctactttggcttcagccggttgctcggatgcattgtcctcatcctccgattcagcgttggattcggcgtccgagtttgattcagagtcggagccagaacttgaactagaacccgacccagattcggagccagattcagactcggagtcggagccttcttcgggctcggcctcagagtgttcttgttgatcctcggtgcattcttgttggtcctcagtatgttcttgctcctcggtgtattcttgttgttcctccgtctgttcatcatcatcaattgtgtcatgttcctcgttctgagattgatcatcctcgttggcctcagtttgagactcgtcttgtgttacctcctcttgtaacgactcttgtgaattttcctgttcaacctcatctacattagattccatctctacattggaatcaatctctacattagattccatctctacattggaatcaatctctacattagattccgcaccaccgtctacattattgattgcatccagttcgtcgacctgatccacatcactttgctcatttccattatcattacactcttcacctatatttacactcttatttacatcttcatttacatgcacatcttcatttacattatcatttaaatggtttgaatattcaggttgtgaatattcagggtttgaatattcaggcatcgattgatgagattcgtcctcttcatttaaacttgaactatttacactattgtttacatttgtacttttagttatactggcatcattagtcttgtttatatccttaattgtatccttatttgtaatagacttatttgtaacagccttacttgtagtatccttacttgtagtatccttacttgcagtattcttaacactagtacccttatccttacgtttaataccctgacagttgaacaagttaatactggcggcataggaatcggcctttatgtaaactataccattgtctacaccgttgcctctgggtccgtgtatttgagcactagtcagctttggaatgttcatcttttcatcgtgaaacaaatctggagttttgacattataatagtcgggctccttctctaccacctcatcctccaagtcgtccgaatctgccataaagtgtttgtacatcatgccatcatcaaagggtgtgcactctatgactatattctcaacagctgccggtttgttgggctttccatgaagcataaccctctttaggttgctgctgaaattgttgttattatcgctctgaatcaaatcctctgcgctagaggaacactgactatcgtaccggctagtgtccttcttgtgcacatcccttacgtgtcgcagcagattggaacggttagagattacctttcgacaatacttgcacgtagccttggcctttttcctgcgcggtttaatactgggcggtggcatcacctccacatcaacattgagttcactcttgatcaatttattgacagccccatcaaagtctacaatgggctccgctttgcgtttgcgatcacgcttacggtatctgtcgtgtttgcgctgttcgcgaatcttgtccagattcttggtgggtgcttgaattttacaagggttagcaagagtggtagtgggtggtggatgcacagagttgacattagtgccattacttttagaattacttttagcattacttttaacaccattgtaaatactaatactactattgttgttgttgctgttgttgttgctgttactgttagtattggcattagaaggcacactaggcacactaggcatactagacatagagactcgtcgacgtttaccgtaattgactggtggtgcgtagtcggcatcgtcagtatccgagtcttcaatgtggggtcgcttcgtcttaatcttgaggggtttaaggagtccgtttgttgttgttgttgaagttgaagttgcatttacagttgtagcaattgcatttgcagttgttgtcattggtactggcattggtattggtattgattttgatcttgatcttgcctttggtcttgattttgattttgttgttgttgttgtagcagccacatttctagcagcctcgatatcaccatgtgtagcagtagtagccgtagcaacagtatcatcatcatcagtagcagccgtagaagtgctcgtattggtaacgatactaacgttggttgtagaatcgcgcgaagagtcaaagctttgacgtctggcttcgcgctgatgtttcaaattctttagcctacgtttgaattcacgatagcttcggcactctcgattgagtcggcgacgttcctcggcctcatcgagaatgtattcgaccaggctaaactctttctgcaccggagagggtgcatcaaacgcatcggtagagtccattgtgtccgcgtagcacaccattgttttacactatttttttttgtgtacacctttgaaactaatagtacacctttgatgcacgaatcgaaaatcaagtcattaaactatagagttttcattgtttgtaaataaacacacacactgtccaagagagagagcacttgtcacattagcagagagggaggagctcaactgaatactcgcacaaacaggagcacacaaaccctacgccggaagttgaccataagaagctttgcgattgactgaagcgactaacctagtcatgaactaatttataatacaatataatctacaccactggtgataaggggtgtattatgaatcaatgcattgtagtttcataattgtggttaccataattatcgctaattacagtaatgcaccactttgttgttgcacgtacagaggaacttccgtgactaatctatgcatttcctatcatgcgtattgtggcaacccccttatctgccctttgttattgttgttgctagagccttacacgtgtatgaaatattttgattaccaatatactggtacctactagtactaacatctgttgataaaccatggcataatacaatcagtctatgttttcagtcaaaaaccataactaaactaaaatctgacatttatcgatcaaaagaacgcgcctaactgaaaccatgcgataagactgctccgtttatatacatgctgccctggctggtatggtttttttcatttctctcacactacaaagtcttttgatgtgtgtgcgtgtgttttgaaaactgtagcatagcgtttcaggccattctagtgctaaactgcattttactgtaaattgagtttctctcctctcttaaaggttcctagcactctgactcggacacttttacattacacaaagcgtttttataatagttacgaaacccaattaaaaatctagactatgggtggtagatgctgttggcagtttgaggatgcgctttgtgtacaactttgcaacttttcctttgattcttttaaaaactaattttaaaacatcctttgtctagcgtgtattaaataaaagcacaattataccggtggaaacaatttgatttccatgataagtctttacgatggcaacctgcatctttcccttatcggtgtccttgtttcctacaataccaagttttttgcaataaatataaagtgggcatcgtaaactttaagttttatgacatccagaagagtgagctgtacccagctatacatgtagctcacaaaaaaccacacaaaaaccataaacccagtctcgggacagagtttcgagaaaagctataaaacccgcaagaggttacgtcacacgccatcgataatttacgatacttttttgtattggatttttcaaggatctcagactgttgtaataaatgtcaacgcatcaaacctagatcccatgtgttttgcatattaccataaaagagcaccctactacatgtgcaagggattaggttgatgaaatttattgcaacttttacgatctgcaagtgcaccctcttttttccaagagtgtgtgtggttgccatttatgacaatcaacacaagtgatgatttctttaaaaaactaaattaaattaaaccctcatattctaattgcacctaattgcagttcctagtaatttattctaagcaatttattttacaacacactaccccattgcctactacctagtactactatacacaatacaccttttcatcctataaagaatgattaacaacaattgtatatacatgtatattataatagacacacaaagggtgctctgaatcctaaacttggaaactaaacctacttttaaacaatctcgtattcaacaatttcataaatctcatattccacaatttcatattcaacaatacaccaactgactgcgtccacttcagaatgcaacaaagttcgaggcatctaaaagaaacttgaaacttgcacaaaaagcgttgaactacaatactactgctcacatataacaacaatagcgtattgacgttatcgcggcacgcacatattagatggaagcgtgtgtgtttcgttgttgataaactttgtaggaatattgaacgtcgccttcgcgcgtacacggcgtttcagagattagctcgaatcgagtcgtatcaatcttggggaaaaagacgttgcactcgtaatactttttgatcgcagtcaagtgtatttggtgacaattgggatgggtcattgccgctgcgtacacggacgctcctccaattacccaggcggtctcaatgtcaccacgagactcgacgactctgatggcttcgtcaaagtttgacactcgcgtggctccatcgtagtcgcctcggtgcttggtggtcagcacaatgtttacccgaccgggtagcggcctgaatcgtttcggtatactctcccaagtcaatcggcccattatgactgcgttcttgttggggtgcgttgctgtcgtggtggtcttggtaaagtgtgccatttcacgtttcaagtgccagggcagtgcgttgttcataccgatgcccatgttgttttcacacacggccacgatgaggtttatcggaaccttgggcttcggtggatacgttatattgatggttagcatcttgggtgtgtttagcatcttgggtttgtttagctttagaggggaacctttaaagagtttaaagagtccaaagtttgacatttgtgggtgtctaaaaaatgggtacctaatgacaattgtacaactaggttgatgcaaaatatatacaaaatttatacaaactatatatacaacatgtacacaagagtacaagtacacactacaaatacccatgattctataattttacgattctataattttacaatacaacttttaatacttgctagttttaataaataccatgtataaatgcaactaatacaaccaaatctcgctgccgagtctacgtctacatctacctacatctacatacacatccacagctaccctctacaccccctctaactaacataattttcaaactttttataaaccatctttaacctctctataatctcactcaaattggtcaacctccggctaatgtcgtacgtcaacatctcgactatcaattctcgtaaatcttgatcaaagaccaccttcagagggtccgtgtgcatggtccagttgactttgcgagcatcctcacaattgtccgatatgcgaaacggtagggccccgttcgtaaaacagtaataagcagtcactccaaatgaccatatatctgaacggtaatcgtacgaagacgacaacttctcgggggacatgtatcgggatgtgcccattagagcggtgcagttttgtaccttgtaccgacacaggccaaagtcgcccagcttggcattcttgtagcgatcgatgaaaatgttttcaggcttaatgtcgttgtgcatacactttaatttggagtgcatgcactgaatcacttcggccacattgagcagcgccctcagcttggactggcaactcatcgatgtcacattgtgagtcaggtccttgttctccatatagctagagtagatgactagtttgtcctttttaaagtttacccggtacggtaccatgacccagggcgttagacgcttgagtttgtagggcacctcaatctctaccagtgtactgggattttttataatcttcatcacgtaaagtgtaccgtccaagtcttcgacgctgtacactttactgtttttgttgctctgcaacaggtgaatatatttgcgcattgtgcaccgatagctccttgtcaaagtttccgaccatctgatgatcaatagactattgcatctatcaggaaatttgcataatagtttagaggctatgtacaccgatcgtatacaaagtgtatcgcaatcatgtttgaggaacaggatcgcaccaagcaactctttgaagagtttataaagagtggcgtcgccgatcccgagacgttgaaaaacatttacaaggccaatcgcaactacatgagtcccgatgtagtggatgccgtcaccaccatcggtacgaagcgaacctttaccgtcggcgagtttgccaagtgtttttcaaaaatcatgacactgcccgcctttgagagctttgccaacagtacgcccggtgacgagcaatacgttcacctgcagagtatactgtgcgagtacctaaaggcggtcagtgcgtacaagaacaaaaactttgcccactttaagaatagcatctttttctggctccggagcaaagtggaacagcccatcaccaacactatgaatcccacaacgtgcagggtcaacgtaaagagttcgtacaagcccgaggagggtgcctacgttaccgtctttaacgatctagtgcgcaagtccaccgaacaggtaaacatgttggccaacgcaaacgtttaccagtttcaatatacgccgaggagtgcctcggtgcagatgctaccgcacagcactctgaacggtatcgtatcgaatctggtcaatttgcagacggtcatgaatcgcgaagccttggctcaaaatctcaagctgccaccctttctggacattgtgcccatgcgtaccgaggcgcccaccggaggcggtcccagtcgtttgaacatgtactaaccggcaatagggtaaacgtcttatgacctatatcgaatattgaatatgctcgttgtacgcgttaaaacgtataccagatgcagtcgccatgtctttttgtagaatagtcgattccaactacaagaagcggaatcgtttgattcactttaacctggccagtgtatttcaaaatttggtcatcaacgacaaagtgtgccaggggaaatgggacgagaccggtgccagatccattggttactcggtgctggtctactttgaaaacgtcgactacctgatccagcaaaacttgtacgtagactatgtgaacggcgaagagtttcccactagcgaagcgctcatctctcacattatcaagctgtacagaacctttaagcaatccatcgaacggcacgaatcggtggtggtgtgggatctggacgagacgctcatcaacgacgatggcacgctaacgtccgaggatctcatccactacctgttgcagttcaagaagcactttaaacgaatggtggtgtggtcgcacggagaccccggtcacgtaatcggacacttgaagcggttgcgactctattctctgtttgacattgtcattacgagatcgtaccacacatcgtacggcttcaacaagggcatcggttttgtactcaagcagctgaatcgaaagtttaaaactacaatgattacatactcgtgcctggtggacgacaagcccagcaactacataggcgactatacattctatttgcgactaaatcccaaagaacgtgatcattcgagagcgttcaagactgcgctaagcctgctaccggatcgcatagacttgtactttaatcatggatctaaaatgtttggaaatttaaagtacttgtaaagatccaagggatttgatgtttgaagggaggtagtgggttgttgtgcttttgttgtacttttattataatgtatcaatttgttttaaagtcctagtttatcaaagtagtctgaacatcctagtttacagtaaagtcttaaagtccgcctatgttgttgctattgcttgttatttgttgtttaaatatttgtaagagtattaggataagagtgtgtagagtagagtgtgccgagtgccgtagtgtgtagaatggagcatgtactggatcatgtagagtgccggagtgtagagtgtagagtgtagtagctggtggtagagctacatagagctataattggcagttgtactaattgtaaggatgattggtattgtaagaattggtattgtaagaattggtattatataatgatgattggtattgtaaagagaattggtaatgtaagaatatttagttttagtttatattacaagattacaagattacaagaattggtaaacctctatgatgggttgtagtaggtactagttgtactagttgtactagttgtattagtagtagtggtactagttgtagcactagtagtgttactagtactcgtatacgacaagttgtgtataaaatgaacaacgcttgcagtattcttttttaatagagctactctgtacaaactcaaatttgcatcacacattgttgcagttgaaaataaccttttatttacaaaacttgatattgtcataaaagtctcataagttgaactcctcattaaaatttgcatattaacctgcacgttattgctatttgcatattaatcttgcttgttaattttattgtacaaaaagtttaaattccttcaaaaggaagagagagttgcacgttccccatagtattactaggtacttgaatctttgtacttatcgagtacttaataaatattaggtataaatctttgtataaatatcacgtttgcgtgtatgtatatgctaggttaatgaatccatacaatcaacaatgtctaatgtacctaataaccttaatcctaatcctaccactaccaccacaacctacacccaactagacattgcaaatgcctccaagttttcgtaccatcgtaaactcttgatgctactgcacaagctcaacgaaaagtatccattcttggcgtcgcacttgaaagtcaacgtcagagcggccaccgatgccgattattacattccaccggcaatggcctccgaggccatattcgtagaggcagagattacaaaacaattgtgcgagagcatttcgtgcaactcgtccggtgtgcacggaccctgcaaaaagacggatgcggccagctactatagattgggcgagagtgaaaactttgaggttcaatgcaatccggcctgcttccacttgttcgaaacggccgtgcacaccgatgacggtaccgacaagccacacaacgttcgctaccgttggtcagagactagcaacacttgcaatatcgtaccttttgcagccacctggatggagattccccggtatcggtccagtgaactgtacgcgcctaggctaaacgatctcgacaccggctttgactatgagccgtccacggacacgtatcactttaacaaatactattgcgacgtttactacgaagcgttcgatcccgacactcgtacctgctacactaaatggtataataaattggccaacataatagtgggcgatgccgtaatcaagctgataaatgccggtctgaccgccatgtcgaacggtaacggcaaaactttaccgcctctcgaaaaggatccacctccggccatagacgacaaatggacagtgtcgggctggcgtaaaaacgtcgatcccaattttaaactaccgcccatagatgtgaccgtgagcgatttggaaacaatgaaccgagtgaatcacagaagcaagaggagtcccaacactataccaatgtctgacaatgttaaaattgtacgatttgatgatgctatgatgaaatctaaaccaaagcctaccaagcctagtactagtactaccaaaaatcaagacattgaaaaactcttaaatctagtcaagagtctcaacgatacatcgggtgcggatcgtgacctcaaaaatgccctagcctcacagactggcaaacagaccaagtttgaatcgatcatactgtcgctgctcaacgaactgaccagcgcagattttgccgccagcgttgctgtagacgtgggtgtcactcaactggccagtcaactaaagacgatgacggtgaaggcgattcaaaaactggtgccgttgctacaaaagaaggtcgccacgttggccatcgacacctcggaactagtgttgggtgcatcgttcaaagtggccgtacgagacttggtggtaccgttgacggtgcgcagtctgggcacgatcggcgtctacctgaccaagagtctggccatggcctcgaccggtgtgggtgtagtcttgctgataacgcaactctttagcatactgctcacgttctgggatccgttgggtttcaacaacatgtacacgcccgactacctgcaccagctgtacgaaaactcaaagatggcgttgcgctctcagctcaagaccaatcgaccggtgctgacgttcgactacgtgtgctcgttcctattgaccgaggaggatttgttcgatgccagcatagaatcgtacacatacacgtatcgctacttggacgccctagaagtcaactcggacggagctcgaatcaacaagggcaacgtgatcgatgtgggctcgatagagtttgaaaagattctaacgcgagccaaactgtttacggtgcaagactttgaagtgtacgagtctcatcacaagctacgcagacaggcctttgacactataaatcggtacacgggcatcgctgtcggtatcggtgtcgtgttgatagttttacgagtctacctgctcggagtcttgatgctcctgctgagcgttgcactagtcagtgtatcgtacgccaacattgcctttaatgtgtggcagtggataacggaccggattaatcccttcaaagtgtaacatttattactacattttctccacaacatggtataaaactggtgcagctttaccgcaatatggtatttgtacttggaccgttgcactattcacagaggctactagtattacctaaagctttaataaatatatataggctacttccactgctaataataacatagaggcttgcaagataccaatacttgtattgcatcttgtattgtataccttgtattgtataccttgtactacataccttgtacctacagattgtaaacttccaactatctcttgtacactatgaatcgctcaaacaacaacctgttgagtgcactgatgggactcttcaagagacccatagcggccgtgtccaatctggtgcgtagccgcagtagctattcgtttgaacacgatcccatatgcgtagagggattcgatgaatgcggcactaggccgatgcacgagctggcacaacagcaccgcctaaaggagctcaatcggcaagaggccgaactgcaagagttgcaattgcaaaaggaggccgagttgcaagacgccaaacttagaatgattgacgaagagatccgacgagagtttggcgtcgaagatattcaagagtttgagagacgctttgccgaacagttgatggccgacttgaagcgtgtcgaggaacgctacatggccaagtgcaagattaggcccactaagcgcaagagcgtagaaccggcaacaacaccaacaacaaccggtggcatctcgaatcgttgcctgcgtcgcgtaaacaaactctttaaccgagactataccgaagaggctgcctatcgtaaactgtctagtagtagtgccaatgatggaatcgtcaagtctaacagtgtagatggtggttgtgttgatagccgtagtcctacacctccgccgccacctactaccacccctacaggacaagacatggtggatgtcatcctaccgcctgcaagtgcacccaccagcataagcaacccaaagaatgattaccgtgccaagctgcgttctagttcaagactgcgtcgtcgtcgtttgtgcagttcgtgttcgagcatcacttccgagtctacgcagagttcgttggcttccgactctgactatggttcagaagttagtctgtttagggctggtgttggtatgaattcagaataaatgtatcctacaatttactatcctacaatttacttggcagttgtttgtaaccaccatgtgtattgccattagatttaagtagtgtacctgtatttatacacatgtgtattgtatatcaaatatttagagtactattttagaatatcttggagtatcttgtagtatcttaaagtacatgtaaaggttttatattaataaataaaaggctcattttttagacacacacaagtgtttttattttttagaaatatacttcaaatacacatacaatacatcaccccatcaaccccatcaaccactctagttttttagattccccaacatggccaacgacgacgaagattcaacactggcgctgtacaaggagcgtacaccaaagcgcttggagggcacgtacagagtttgcatctacgcgtgcatggatccggaacggttgacttccgaggttcgagtctctgccgccaaaatgctctggtatgtggtgcatctgattcccaccgacttgtacaatctggtggtgtgtgactacaaacgagactttttcgatatgctcagtgtactgttgaagcgacccaagattgatggtgacaaggtgtccgagtactttgtgcgcatcaagcaggatgcagacactgctgccgagttttacaagtttgtcatcgaccactatggcctgtatccggttgatattgagaagctcaaagagtggtggggtcacacgtattggcgctttctgcacctgaccagtattctggctcagaacgacaaagagctcctggtggcctttgcgagcattctcatcaatctcagtctgattctagtgtgcggcatgtgtcaggaaaactatgacaaactagagcccatcatggcaatcacctatcctatgctactgactagcgatccagttactcgaatctatgacctgcacaacaaggtgaacttgcacaagattcacccaaccaaagagtttgcatttgacgactttttgagactctacaacctacgcgtactgtctgagcaacatcagagtttgagtgcaattgtgcaggtgccctagggtggctaatggcgagttgttggttttggtagtaagcttgagtgttggatggtattggtttgttattttattagagtaggtggatagatggatagttgtacctatgtttagctttgtattgcaagtttacattattttataccattgtacattcttgttttttgagaatgtaaaatggtgtataggtataacctctttaccaaaccaaaccagttaccaaaccaaaacctttaccgcacctcctatgctagctacacagactggcatctactggtatctatactaggcctctactctgtctactttgggtttaactatactctgaattctaactctatactctgagttctagcactactctgagttctagcaactcttttatagtaactaaaggcaccactccaacactctctgggataccacagtagaggttgcgtgcaccgtttagtttggtgagactcggtgctcggagctcggtgctcggtgcttgtagtttgtagcttgtagatgtagtaggcaggcaggatgcgtgtgcgtagcttgtagatgcagatgcagacacggagcgcagggtaactcggagtgcagtgtagactcggtgctcggtgcagggcaggatacttgtagaataccaatactcttcagaataccaatactcttcaaaaagtaactctatactcaatcacaactctataatagtctcaaaccctagtggtaactctggttttatgtatttgtatatttgtatgtttgtatcaaacctaacacacaacaacagcctacagtacagtctacctaactgtaacaaaacactctacctaataaaacactctacctaacagcagttcgtgtaaaggttgtatcaggatgcaggatgtataaaatgaaacaacaaatgtcaccagtaattgttagtttattgggtggtgaaaaaaaaagaaaaaaaccgttttaatattaaaatactgactctacgttaacgttaattggcaagagcgtgcacgttttttgtgtgttaacgacaatgtacatcggagataccaggcagcgttatcgtagccgattactgcgaggcaatcgatcgcatatgtccacaactcaaacacttgcacgccacggttgcaacaaggcactaaggcaatctctttgcaaagcaaacaagcgcacacgccacgagagactgcctgaaagacaacgtgacggtgcgagggggttggtcagtgggttgttgtgcaatgcgatactcgtacacagagcctaacgatcgcatcgcacgcctaggtgtgcaagacttttgctgcattctaatctacacgaattgtgcaagaattgaatacaacaaactctttcaatacgataccatttagagtatggttagtgaactcttgtatggggatgggttggttattattgggatatgaggcacggagagcataacatgcaccactagctttggtgttgcatgcgatacaaaccatgccaaaggtttgactctacgccctcttaaacggtaccgaaccgaaacgctcatagtatcaaattctgcactagacaccctacgtactgtgcatttactacgtgtgcttaacttatgtgtgtgcatttgcctaaacctattgtttgataccttttgtttaatacctttgtttaatacctttgtgtaatacctttgataccgttatttgataccaatacctttgtttgaaaccgttgatacctttattaaccaataccaataccaccagagttaccaagagacgccagagtcagagtcaccgagttaccagatttgttgttgtagttgtatatgtacaaaagtaccagagtatatcagagtacagagttctaccagagtatttaccagagtatagctttatcagagtaccagagtacacaaagtttgccgagtataccagagtatagtagttgcagagtaccgtacctagttgtatccttgcatttatataccagtatatgccagtcttaccaccagtctttaccagagacactttgtcattatcctaaatgtcctaaattatcgtaaccctaaattggtgtgtatagtgtgtatgtgtaaatgtgtacaacccgtgtttttattttatatgttttttttatattgtttgcaatagtaggaagtaggaagaagaagacgtatactacacaaatcaactcttgtttaccgtcgtgtatcaatttataattcaattcataaagtatcacatcttactacatctattgatttgtgctcacaccgacttatacactagccgcacttaaatctaaccggacttataaactagccgcaccgacttatagctaaccgaaccttatatctaaccgagcctaccttataactaaccgagccttataaactagccgtaccgcttacagactaaccgagcctaaaactaaccgacctaagctgccgagactgcaacagacccaacgaccctaaccgattgtgttttgttgttgtgagcacaaatccatgtgtgtatgtatagatttaaaaatgtttggtaggtacccatagtagatagtggtagtaatagtagaaggatagaatgatagaatgtatggtattggttttccgtttgttttaatgtacttttgttttgtttggtttggtttgtaaaatgtgtgtcagtgtcagtgtgtatgtgtaagcatgtgtaaaaccctacctacctagattcccacagatggtcataaattatctcataaattatccacacaatatcaacaagtataaaatatcaatcagtgtcaagtaatgaaccataaaatgtaaaagcataaaataaaaagtattgcaacacatacctatgattatactcggcacactattgttcccagcacctctactaaacgctatcctctagtagtagtactgttctacatataagtgttccatcaagtctcttgtaaatgcacagtaaaaacaaacatcttgcactcaaaaacactacactaacaaaactaaaagtccctatggtggcacatgtgcaagctacgcctacctaataataataaaacagcacacacgcacacgtgtatttatagatgcccgacacgcacacattaccattgttattatcctcaaatgcacatgtgtgtatataataaaaacatcctacctagtacatgccgggccagataagactaatgtagaataataacattattcataaacgagagagagaacctacagtttatacactgtgccaccaagagtttaagtctcgacactgcattaccgttgccgatactacagtgccaaaacgggtaccagtatgattcgagtcgaggtggcatctgaataaaatccattcaaagagtccaccctgcgtattcaacgttaagcgacagcccgagtcatctatgctacctactccctaaaaagtctaagtctcgacacctgcacgcgaatttagcatccactcgtgcgacacaatcgaaccaaaggaacccgtttgcataggagcagtggcttgtgaccaacaaggtcgcatgtcgcctttaaggaacacattcggacaacatgtctcgaacacagagcggatcagatgcgagttgtgtttggttttggcaaagagcagtgctatcgtttcgtaccagaccgaggtccgattcgggtcgattactccgctccataaaatttaagtatgctaagagctataaaaagtgtatcagatgacccgagactgcacattttaaaattgaataaacagagcagacaaattaaatgaattaaataagaatgagccactcacctagtaccagacgctgcctacaccagtgcggtatgaacacgactcgaatcagactgatggtgttcgtcaccagtctcggctttttatagtgcggatggcccccactctgttgcgataagaaccgagcgacgccattggtcgatgagtaataaaactttatcagaaaaacgtgcacacctactagattcttctgcggggggaacgattcctcttaatgattcttctacatgattattcttttttacatttttggactccttttcacaagaccatctgtgggatacctcacatgtggtgtctctgtactctggtttgtcctaaaagtgtacatttgtatactttttatcatttttaccgctagctctttaaattttacacttttgatgcatccaatgcatctgtcccgtctctggcgttgtctagtctatagccagtcattggacggctcgctacaacattaaatactacccttttataacaataattaaacgcctacaattataccggtcccgagggtctgttgcgacctaaaggtctagtttctagattccaataccgttattctaaccgtgtgaatgaattttgaatgtatcttcaacgtataaagctataaacaaacgcttaaattaacatgcataataaattaacacaacaagatggcgacgtgccacacccagttcattgtttacaatcgaggttataccaattcagatgcaaatcaagacatttgactgatgctaaaatgtagccagacactttaaactacactcttgcgcatagccgggactctgcgcgaggggtaactgtgtcaattttcaattttgcatacaacgttttataacctcaaatgtagacgattatgtatatagagattgttcaatactaaattatttaatactaaattacaattgtttaatatttaattacaagtatagtccgtgtttattttaaaagtagacgtgatgaaaacttaggtctacgaggggtgatgttgatgttgagagaggatgaatagaataatttgaatatggatgtagagagatgatttgaatgtgaatgtataaagatgatttgaatgagtaaagtctggaaagatgatgtctgaaagtctggcaccatagtctggtaccgtcgagtcaagtcaaagagtcagttgttgttggatttagtcagtcaaatgatgcgtctcagtctacccattcaggctacccattcagcctaccctttagagtccccatacgattcccatagtagcatatgccgagtccctttatagatagaatattcaacgtttataaccgagatccgttatagatggaaacaacgtttgtaaccgataccgattgagaccgttcttctttcttgaatccagagtgtattcagagtttcttattctacagacagatacaaatatagacatacaaatacagacatgtattactacagtagatgttcaatagacattcttagtccaagtattcttagtctaagttctaattaattccaacattatacatttatacattcgtcccttgtattcatctcaaaatggtaacattcatctcaaattggtaacatcagaacacgctagacgggctccacattccgaacccaaactggttccacataccggtttatacgtacacacattccaactttaacaaacacatcaagtttaaacaggtttaggaacccaaaagcattgttaaatgtaaaattcaaaagcatgcaaatacctgtaacggcaacctgtacgattgcacaagtttgccgtgcactttatataggtgcacttgttgttgttgttgatggtttgatggtttgatggagagcgactgcatctgaaacacacaagggttagctttggagttttgctgcatcacatctgaaacatttaacattaagacatgtttttgcattatgatttgagtacccttgtattctagcattatcattattcttacaaactagatttgaccatttatacaaaccatactagagagatggatgtactacaaaccagttgcatactataccaaaccatccaaaccaatccagatgttgtatgaatacatcaaccattggaatattggatgccataggtagactgtagaatggagcctctatgtagacctctgtgtaggcatctgtgtagacatttactgtgactctgcaacatttaaattgttagacacttggggttagtagtagaggttagtattagaggttagtattagatgttagtagcaagtagtattcaaaggtagtagtcaaaaaaaaagagtgtgcacaaaccaaacacactgatgttttgtgtaatgaatgttttgtgtaatgaatgtatgattttgtgtaatgaatgtatgattttgtgtaatgaatgtcttgtgtaatgaatgtcttgtgtaatgcatgttttgtgtaaatgaatgtatgaatttgtgtacaatgaattgtgtaatgattgtgatgatttgtaaagtgtagtgtaatgcattgtgcttatattgaaccaatacagttcaatctcaaatctagaatcaaaggactcttgatttggtgtgtagacttacaactagaaataaaactataatgtgtattcattcttaaaagctaatacgtgtacttaaaactaggccgtattcttaaaactaacacgtgtacttaaaactagaccgtattcttaaagactagacgcatccttaaaactattcaattcttaaaatctaaaacgcatcttaaaactagaaaccgcaaatcatcttacatctaaacgttgcagtcaacttatagctaggcaccgtaaaattcataccaatcatctttagtcgtaccaatcctcagtcataccaatcttctttagtcataccaatcatctttagtcataccaatcattctcaaatatactcgtcagtctcaaacatgccaatcactctcaaacatatacattttgtaaacatagtttcatcatttaacaatacttaaaactatacattaggtagttgcaacaaacaccaatcgttatcttgaacaatgcttgtgcctagacattccaatccaaagtagcaccaccacagcatcaatttccatggcaacagcgcatatcacgtttctagacacccgacgacagcacttggtaaccaatatgcttcctagaatatggccattaaaacgaaaacaatagccttgtttatgccacacagtggattgtttattcaggtgtgcgatatcaggtattcttatctcgaatggcctagatgaaggggtgttttttcttcatttcctatttttcaattctttagtaaacttccacagcgaatgatgcacatttcaagtgattgcttgtactgcattgtaggcacgttcaaatccttgtagagtttaatcctttagaatccaatcatgtagaatcccacttctgacaagatgacttccgagaacctataaaaggtttaatcaaatttaaacaacacgggacaataggatgggaaacagtaaaacacttgttgttgttgttggtgttgtagtaaactctttattgaacctaaaagtgctctaaacctttatacgtaccaaatcaccaagtatggtagctgtccaatatccgtgctcaatttacatcactttgcgtcaattacagcacctgcaatattgaaaccaaattacattagctgttatattacaagtctaggttgtatactcacagagtgctccttgtagctgcaaattgagtatgctgtaccttggacgaggggttgtcctctgcgcctgaaacagtacaatagcattacacttggatggttggttgctttggtttttcagtaggctgttttatacttttgtttgtattacaattcttatagtttaaaacagaattcttatagtttaaaacagaatttcttatagtttaaaacagaattcttatagtttaaaacagaattcttatagtttaaaacagaatacatgtataaattcatttgaatactttacaaatgaaggattctgaaacaaagagacttttgattagtgcatctgaaacaaagagacttgttattagttctcgaatctgaaacatataaaagtttgattaaacctgaaagagagaatgcattgattagtggtacacatggttatagacatatagacacatggacacatatacacacattatttcaaacagttgtacaaaacatttaaactacaagtatgcatacctgatagataccaatacttaccaatacatgatacttaccaatgcataatacttaccaacacatgatacttaccaagttgacattgtacaatacttaccaaatcaacactcaccattacttaccaatacttaccaaaccaacaattaccaacacttaccattacttaccaatccaacacttgccattacttaccaaccctcgtcaggttaaggtagagcatataggtgcagttgtctgctcagtctcctgaaacacatttaattgcaatcttagtacattctacccatcagaatatttcaacaatcaaacgatacacaccttgtataattgttatatgtataatttttaaatgttttacaacaaaccatcttaccatcttaccatacatcctcccatactttaccaaatccaaaatccaaaatccaagcatcctcagagtaaaccatccaaggtgtcctcagctcaaaacatccttcaccgcaccaatacaccagtctctgtgcaagttttgaccgatgccgctagatggttctgtaagcacacaaattaagtgtacagaaagattcccaaccaaagcactgctgcacgtatttataaagcgattcaatctatgcatataaagagattccaagagccaacattgttaatgttaatggtttgcgattataatcagtaaatgaggtttaatgatggtctataaagcggctaggaataatgtttatcaatcaagctaaatgaggttttagattgagctttagaatgaggtttagtgtataactgccaattaatgtttcaatcatttacttgccaagttatggcttattagatggacacgcttaatgatgtaaatgttggttaatgatgtaaatattggccatgttgatggttggttgttaatcatggttaaatgtttatgtttatgatgaatgttctttgatagcaggcttggtgttattatagcaatttatcccattatagcaatttacccgtcaacaagcaatatgtgtctgtaaatgcatacattactctagatacttactacacgaaatgtgcatgtataaatgctaccgctaaaagagccaagaccattagtgtctgtttaatgtcaatttagttttaccgtcagttggttttaccatcagtttactccaagtatcccactttactgcctggttaatttaatgccagtttaaacttttagtagcaaattatttttaaacgcccaagctggtttaatctaggcatctttaccgtcagccttgttcaactctggaaagctatcaaatacttcaagtgccaatttagaatctcttggcttgtaaagttgtataatagatgcccacttccgtgcattacattactaggtggtccagtttatggcagtataacttttgttattaatatacacactcccagtttatgcatttaatttttcacaggctttttaattttcacataccattttatagcctctataaaactataattctaaattatagaggcgctcttccagtaaacttgacaaatgcataaatttcacaaacctgattaacgctactctaaatttatgcacatcaggtggtgttattctttttaagtatatccttcttttatactataaattatattcacatctagtatgctattctttaaactagccaatcctctaggttcaaacattcttccatacaatgccatcaaccgagtacctagccccggcctttgatcaaactattgaaggtggcagagatttgtgatcttatgccaacttgcaagagccgccctggttgcagagtgcaacctgagagatgcatttaagatgcatttatttgttataatcatttatcatttactctgacgcttcagtatacttgacaaactgtacattcattcaaaacacttgttcacactttatatttcacacttcactgtatatttcacacttcactgtatatttcacacttcactgcactgtttcactgtttagaattattttagaattattttagattttagaatatattaaaattccaaagtttaaatcaaaagttacatcaaagtacactgactcgaatatgcaaacactgaatcgaaattgtctttaatatataaacactttacactcaataataataatcacacacacgcactgtccacttgtatatttcacacttcacttgaatgtcaacacggtaggtactctaaatttaggtaggtattccaaatgtccaagtcaaatgttagtttaagcaatagatacacacacattttatttagtacagtgtgcaaagcatagagaagcaagtgtatagaaaagaagccaaatagatacaatacttgaatactacaagggtcgtactacatgcaagaagtgatgtcgatcaactacctactcactcatcgcattgtatcgttaccggcacatcaactcttgtagattgagacattgcacagaatgcgcttcaacctatagatttgcatcattacaaaatttatacaaccccctctatgtctctatatgcaagtgtccaattagcatagtccaatcagtccaactttacgagcattcattcaagaccccatttaaatcaagactagctagccaaatttaaatcaagtctaatttataccggtttaaaccagtctcaacttttcagtaccccttaaatcaaacaattggattctacggttaaagattttacagttgttaaagttgagttatagtcttgtggatgatgcctttaaaatatcccagcaacctttaagtgccccagtaacctttcaataattttaaatggtatgtacaactcttgttagtaagtattggtaatgtgtaaattattaaatagtattataacttgttaaatattatgcaaattattaaatagtagccagtttaatatatagttttaatatgcagcattatatagtatacacaatagaagtcaactgttacaagagtaggtagagcgcaaagcaaaatattggactcgtattacacagttttataaagattagtcacgccgccgagcttacaatgcaggttcaagttcaactcccgagttcaagtttgaatcaaagagcccatttagttataccgagccacaccgagtctaaatgatccagtttaaacaatttgaatcaaagcccgaatccttgaccgagtctcggtttaagtttaaacgaacgagttcaagtttggtttagtttgatttggaaacaacgagtcccgagtctctataccaaaagagttaagagtttaagattacaagttttaagattttttaacgaagagcacacgagtcccaccgagtcacactaaacgattccaaaagagtttacgagtacacgagtcccactaaacgattccatatagtttaagagtacacgagtccaccgagtcacactaaacgattccgagtcacactaaacgattccaaaagagttcgcgagtccaccgagtttacaattacacgagtccatcgagtttacaattacacgagtccatcgagtttacaattacacgagtccaccgagtctaagattgcacgagtccaccaaaagattccccaccgattctatcaaaagagccccaccgagtttacatagagttcacgagtcccaaagagtcccaaagattccaccgagtctttacatttattttaaacaacgattccccaccgagtttacccaaagagtccaactaaaagagtccccatcaagttacgattcacaccgagttaaagagtccccaccgagttacagattcacaccgagttaaagattccccacaaatgtaacaattcacaccgagttaaagattccccacaaatgtaacgattccccacaacgattcacaccgagttaccgagtattccgagtccccacacatgtacgagtcaaaacacaatcaaagagtccatcaaatacaaatcaaaacaacaagtgattcaaaagagtactcatctgtgactcctggggctccctctgaggctctgggttggtcctttggctgcttgttcctggtccgggtgtgtaaagtagactgaactgaccagaaaatttgtctctttatatactgtttcagacaaaggaattttgaaaatcaaatcttatcaaaatggaaaactaccaaggtcaattcaggatgtacgtgcctatgagcacgtagccagaattgtcacaaatccaaagcttccgaatccctcatttctatgtaagaactcatgcctttaatatcaatacggtattggggttattgtttattgaaattatatataaatgcacactcggaatggatcacgattcgctgtatttagagtttataaacaagacgatcggtccgtacggagttgcgctgcatagctactttgtgggaatcgtcggaatcatgactgttattgttattatgatttcgtgtttaactcaacgatccgtgagatgcaagcgtacgattcccaaggaccgaaaggtttatgttacgtctgggaactcggtctattgatgcttgtgtttttttagagatttttcaagatgaaggtcatttcgatgaacgattacgatatactcgtacaggttgaccgagtctacgatcccaaactcgtgtgcgaagaggtggattctcttgtagacttggactcggcaaccaaggccaacgataatatcgttgtcgacaccaatggaatcgaaacgtgtttagcagagtccgagttcaaggctgagcaaaacaatgaaaacaaagactcggagtcgccgcttgtgaatattgacattttaaaactcattctaccaaagagtctaacaatgtggctctttaccaacaagactaaatggtacagtatagactcgtacaagtttggagagttgaccgtcaccgaggactcgctcatcgacatgattcacaatcgtgaaattgtagcgtttgcctatgcaatctataggactcacgaggacgagcaaggagtctggtccgacatcaaagactcgattcgtatcatttttggagtcgttgaactcgtaccaaactcgatgagttcatggttgcgcactcggtacttgcccatcaatgagattgaatcgcccaaggtgtatcctgatgctccaccatttgtgctgcaatcgatgcatcgtccgcgcatctggttgaccgcatacgaaaacgtaaagtgctccgagtgcgggaatcgcatgtactcgctcaagggacctggggagccatcgttttgctgtctagactcggagtgtgaacaattcaaaatgtgcaccgtatcgttggagtgcatcgatttcgaaactggcccactcaacgatttgaagaaatccatcaagactcgttcgaggtactgtaccgaggacgtgttggactcggtgaatcagtacaatcgttcggtggcgatgctgttgcacggtagcaaaaaactaaagcctggcaagatttcaagtggactcggtaaatcaaaagtggactcttcatccgactcggtcatcaattgtataaagtgtaaaaactgtaaagtgtgtcaacgcatgcttcagaccaaacagactcgatgcgctaggcatccagtgtgtactcatttcatgctgaagaggaggctcatgtagagtgagaaaaatgttatgtttagtgtaggtaggtagagtatgttacttgtatgtatttaaatgtttaagaaataaataaatgcaacttttagttttttagactcttgaatctttattcaaaaaattaaactttaaattaaaacatacaatcaaacacactaggtgtacacctcacgtaatcctaggagcatttacaaacgtttcgatatagttttgatcaatgacaatcttgcctccaaagtcgatggcaaagtttttcaagtgcttgaaatcgtacacttctttgcagtttgagatgctcatgaaaattataaacttttgacaatcgtaattaaactcgttgactacatcgttcaagtgtggcatcgcattaaacggacacctagacttggagtctgagtccacctctgtctctatttgaacattgtcctgttgttgattctctacatccataacgtctgtttggaaatctggccgagtctctgtttgaggttctgattgagactctgtcttggtatcctttgccttttttggcacctgactagatcccaagtaatagtgtccattgttgttgcttatactgctattgccgccaccaccgcatccgctcatcattgaactgtgaccgccgttggccagtttccatgtgccggtagcgatgagctccttgtagtcgtgcacgttttctctaaacagaatcagtctgcttccaaagtctcggtagtaccacagcttcatgtcgttgcacagtggatcgtatttgctctcaatgttcaaactatagcactcgctctggttgggtgcaaaggtgtaaaacaccgacagatagggtcgggcatcgttgtacgtctcggacactccgtccagtttgctaatgaccaacggtaccgcaccgctgtactcggaactcgtaaacattgtaaagtgcttgagcggggatcgtggaaaatcattgcacagtatctgctcatagtgcttgtcgctcaggctcattcctatggtgtgaatgtagacatttttgtaatgagtcgaattatccagtagcatgttgtagtctctggatacgagctccttgagccgtttacgttccatattcaagagaaacgacattgttagttttgtagattttgtcggtatagcgtattggtgctgaatcgataccggtatactttaatgggactcggtgaatcctgcaacaatatgattagcattttcagtgttataagttttataatttatacaacactgtgcatgtgcgttgcggtactagtgtggaagcctcagttggtggccaacattatcatacgcaactatccatcgcaattgtacagcgatgcatcagacgccgagtatgtcgagcacgagtaccgagactctaaagtgtacacgtacaacgacactggctacgaaccgggttcaccggtaatcatctatctgaacggtggcatgtttgtaatgatgtcgcccgagctgagagccctccaagagtttacccaccgacgcagactggtaacgtttacacaccctgtgcgattcgatgccgaaactcgagacattgtcgagtacattagagacttgattgtcaactacattccaacgctctacgcaaaggatccacccaaagagtactttatagtggcacactcggcaggtgccttttacgccatcctcatgattagactcatcaacggcagcactaaacatgatagtagcaacatgtacattagtcgattcattggtatcaatggattctacggtagcagcacaaccaagtttctaatgttcaaactcttgtcggttggttatgttgaaaaggatctacctacaccggtacccttgtccatagcgagctacacggatcgtatacacgtactcacaaacactgacgatttcatccgagactctagtgaggcgtttgcgcacaacaatggtgcatcgttgcgagtgatgcccggagatcacacttcactctacacactgtccaaacctgaatcggtcaaaatgtttgagtatttgaacgagttgattttggagagttgaagttgctgttgtgtttgcgggcaatgtaggtacctaccgaatgaccgagtgttgtgtattaacggttgtgcacctttgttgagatttatataccaaggatgtaatattgtagaggataaaaaaatgtggtattattttactttgatttactttgaataataatgaataatacttggtattgtagtataaatatatatttaattatttatattttttaataaaaaataagttgtattacaaacattatccttgtagtcattcttaccaattgtgcttaaaagccatcttttagatgctcttacaattcatcttttagatactccttttagatactcgtacaattcatcttttaggtactccttttagatactcgtacaattcatcttttagatactcttacaactactataaatactctcaagatttcataccatgtgatggtgactctatagactaaattctagattttaaaactctacaaactatactctaattttaaactagatgaacactggcaatactggtatacaaaatatatagatgtaaccaacacttgttatattaaaatgtacaacatctctctacaacattaaagtacaaacattaaagtacacttagacattaaagtacacttagacattaaagtacacttagacattaaagtacatttgaaactttaaagtacacttagacattaaagtacacaaacataaagtacttatacaaacattaactactcttcactttaaaacactcattatcgctctctctcttaaataaagtgtatcggaaccagtgttgaaacgctcatatccttgggtggttccacgctaggctttgggaacttggccagcgtacccttggacagcctatctagtgtggcataatctttggcgtacactttggcaaaggattctgatgtatcacttctagacttgttgagcatgtcgtccacatcggggccttcgaaaccctccgattgactgattagcgttattatgccggctttgatgaattcatcactctcgcggtactgttgcaagagtgcagaaattcgttcattgtttcgatacgctcgacggtcatcttcgtacgactcgttaatgtcatcattgagtatagactcgtactcttcgagcgtggttattatgctatctaaagcatgctcctttatcgtggcttgcacagcacccaggaatcgattcaccaccgcctgtatgttatccttaatcttggtgttgagtaggtagttggtgtatctaccctgcttcttaaacagttgcttaaacatggatctaacctgtttgaatttgttcagttgaacagggtcgaagccatcaccgctgggatcaaacagttggtagttgttgttgttgtacagattgacgataaagttgttgcgcgcattcagtgtcacacctcgtatgatgcgcggcaacagaggcggtgccttctttggtggtgtcgcctcgtccggtgagggatcgttgagtttgcgtttttgtcgtttggccttgtgcacaatgggcgtctttggtggagacatgctagtgtcgctggcactgctagtgttgctggcgctgctgttgtcagtagccttattggcatcagtttcaacaacagtattggtaggaggtgtactcttaacaggagttgtactcttgtttggagttgcactcttggtaggtgttgtaatcttattagtaggtggtggtgtactcttaacaggagttgtgctcttagtaggtggcggtgtactcttatttggagttgcactcttagcaggagttgcactcttagcaggagttgcactcttagtaggtggtggtgtactcttaaccggcggttcactcttggtagtagttgtgctcttgataggtggtgcactcgtggtaggtgttgtaaccgtattaggaggcgtaatggcagcagtactaccactagtagtgttgctggtactgggcttggacgagtcttcatcgtcactgtcatcactcgactcgacaaactctggcgtcaggtagcgtttctgtctgggcgatttcatggccgttatccttcgtcgtttcgttggtgttttggtttcagttttaatttgctgcaccgtctgttggaccgtttcttgcatgatttgatcgtcgtcagtctgtacagtttgctgagtggtctcctcttgtacggtgtgcatctgtttggtggcacccttttgtttgacagccttcacctgctgcttgacactcttcatggctctggttttggctttggtgacgcccttggttttcaccaccggtgtactgctctgcatgattgctttaacgtttgacggttcgtacaagtcggtgcttacagtttgcttgacaatggatgtatcgttgctaacaatggatgtattggtgctagtattattgttattgttagcattcttaaacaaatttacatttccattgttgttaatgtttttactaaacgcgaccaatctctcggggggcaaaggaatactgaccggtagtctcattggtacaggggtcttttgttgaggctcggcttcaatcattggttctggttccattacaatgtttatgctcgtatcaagttcagactcgctctttattaacgattcgtttggtgtagacgatctactcggacgcatgtcaacgtctgtattgcgtatcggtgtgattgtagtgtcggcaaattgcaccatttgttggataggtgtaccgggcatcactttgatcggttgcaccaccttactttgactctttctaggttttcgtacacgtttgggtgtaggcttgggcgctggctctggctctggctctggcctcccaaagtcgatgctctggttttgcatcctgatctgagtctgtatgtctgcatcttgcaccatgcgtctgtttagagcttcaaccatttcgacattggtttgatcaaaaacattagaattgaaagcatctggatttacagtgttgacatttgcattgttaaagtttacatccatcggtacgattggtgcttgtaggtttgattgaacactctgattcattagaaatctatcgacatcgtcagtctgcgtctgcagagttggcataaatgttttgagatttcccgaacctactcctatacctacaccacctacactaccgctaggttccacattaccatttgcatttgcattaaactctacattaccgtttagattgacattggttccaaaatctactacaacattgggatctacacctcccgagcctcctgatccggtgtctcctccattgccgccaccgaagccaccacctccggcacctcctcctgagcctccgaaaccgcctccgaatcctccacttccaccgccgcctgatccaccgaaaccgcctccaccgaaacctccacttgcaccaccgtttcctcccccattgcgttttacatctttatccaaggtatcaatgagcacgttcaactgctccacaggcttgttcatgcccttgattgatttgttcaactgaatcgtctgatagtctcggacaatcttgttgatgacattcaaacgattctgtaaatcgttcataaagctaggattgatcttgagaggtagcaccatagactcgaccaccaactgttccgaattggaattgtcatagtccatgagcacctctgcaaccaccacgttaaactcatcgaccattggtttaatcttgttcttactgtcaatggtggtgagaaagagtctacgcactcggtccacagaagtgttgtcgttgttgaaagacgacttgagagagttggccttgcgctgaaacgtttgcgtttgctcctcgatttcattgtagcgttcggtgagcctacgcaaacgcaaattgatgcgactcatcatacgagtggccaattgtctgagtttcatatagttggtgcgtttctcgatcaacactctgggttggaccgaggcggtgtctatcatggcaaacgtgttgttcaacaaatcaatgtactgcagcagagcgtgcttcatcgatagcaaaatgtttctactgcgaatgtaggcaacgtttacattgttggactgtttgggatccaactgcgttaccgcattgtacacgatgggttcggaaatgtggttcatgaacgattccatcgtccaagtaccgtcgtcatcgccgcgacagtttcgtactcgagtctcgatcaagttgtgctcatcgtcaacgtccatgtttgcagtgcttgtatctaaaaaaatataatgtcctaatctaaagaaaatgcctatgctaaaatctacacttttagtgaaactctaacgtgatcacccaacgtttgcggtacaaagtttttatagtacatgaatcgattcttggggtttgtatagttgagatggtgctcaaacagagtcggcggataaatgtacagctggacgtcttgcaaagattctccgcagccctgcagcgtggacattatcaccgacattagataggacatgttgacgtcgggcaccatgttggcgatgctcttgaacactatcgcaccgagtacgagctcgttcttgcccacacggacaccgaccgtgcccagattcgaggatggatcgcgacacagcaccttggtgtacacatcggtggacggtgcatccggccgagttggtcgatgatgggaatcgtaaaagtataaagaaactctcatttttaaacttttgaatgcaaatgcatagaagcgtcaaggaatcattaccatttacaatcacaaccgatataggttattggagtgcacaatagtacgatttaaacgtgtatacacttgtagacttcatcttgccggacgttgtactgcatgcacagaatcatgatgactagcacgcacagagtcagcagagtggccgtaaacgcttcatacttggtaaataggatgcccatcacggtagctgcacacgtagacagtatggtttggatgctccaaggtgcaccgatgcacaatcccttggtcagagtctcgcaattgatcaacggatagtaccaggcgtgcagtacgttttcgctcttgatcaggagctcgttgagacactcgctgcacgcatacgtgaccgtcaatactcgatagtgcttggtagagtttaaattcaaaaagttgcccttttgatacatgcccggatgaatctccaaatccaaactgggtatgcgtatgaaatagtgtgcaatgatgaacgaagagtttttcaaacgcttgatgcacatttcaaccgcagtctcttgcatggttagttttgtttaaaaaattaaagcatgcgtctctatacttgttggcggcgataagacctatagcgtattatcgcaaagcagctaatcgagtattgtgaattgaacgataaaatggtgtttactcaatttgtgtcgtgcacgctgggagcggtgctagtcatcgctctagtttttttggtagcactcatcgtgtttggctatgctgtaaactcgatggtactctatagatcaatctttaacgttggcaacgttttggatgaaaacttgagctttagagatttgtacactttgtgcaagcgactgttgatggatcggtacgataggctgtttgatacaaagacggtcaaagaggccaaagagtcggattcaaaggttgaggtagaggttgtaaagagtgattcaaatgttggttcaacggttgattcaaaggctgatttggatgttttagagagcaagacggaagagtccactaaagagccctctaaggaattgtctaaatcagagccatctaaggaattgtctgaatcagaaccctctaaagagccagagccctctaaagagccagagccctctaaagaatcagggagtaaatctaaaactatagattcggttgatggtacagtaaaggacagtgttggtaaagacaatgacaagagcaaagataagagtacggatgatgatgaagatgaggatattgaagagctcgactactatgcagacactgtgaacgaagagggtttcagaagaggtgattgagttttagagtacaatgtcatgttgcattttgcatcaatgtagcagtagtgttgcatagcggctaataataagagtgtttaatggtttaggtaggattggttttaggttgaaacattgagacacagactgatttagcaacacacgtttatttataaagtttacgggttaatgttaatgttaaggtttaacaatacttgttatttgcatttacttttgtgtcgacttaagttgcatttaattctagattgtattcatagtcttactttttacactggtaattgttctagttttttaaacacttgtaatacacatttttataaacttttattacaaaaaatataaactataaatataaaattataataaagtgtaaagtgtaaagtatagtacaattgtaaattgtaaagaagtaaggatgattctaaagtacaatataaaagtattggtgacttaaactaattcttcaaacatgtacactctacactcttacaacatttatcctcctacaacctctaccctcatcctcctacacatcttccgcatcctccatctcgacagacttttgatcattgcaacactctagcctacctgcaccagaggccaactctttaatgtagcgcagagacgttactccggtccagtccttgtcgcttctgattctaatgacacgcggaaacctaaaggataggctggccgtcagctctgtgcacagcacctcaagcaccggcatctgcttgggatcgagtgcaatcatcgtgggcagtttgcgtgaatccttgacgttgacaaatcgccagggcacatccattgcggccgagtgcaccatcaacggttcaaggatgtcgttgagttgtttgatttgtacatcgttgaggccggcgtgcacctttgtcaaacccacccatgtcggttccacgcaatcgccatctaagcatcccatcagaaagacggagagtagtcctcccaggcgaccggtgccgtaccaggcgcctaggatgaccaagtcggcagtgtctccgctattcttaaagtagtcgcgcttcatctttagccatctacgcttgccgggcatgtagcacgaattggcacacttgagcatcagaccctccatgtttaagcgcatgcactgtttaaactcttccataaggtcaccgggtgaggtgatgtgcttctgttcagagagaactatacgattctcgatcagtgttaggttgtctttgataatgtctcgccgaacagacagaggctctcggtacaggtagcgtccgttaaagtacatgcaatcaaacactacgatgcacactttggcgcttttgaacgctttacgcttgtgcacaccgatggcgtcaaacggtagaaccttgccagtgtccgtgtccatcatgagcagttcacagtctaggatgcaggtgcactcagagggcagggctcgttgcaacaattgtgttaggtcaccgagcttcttttcgggtacgcatttcagtgagcgagaatagtacttgaaatctgagcgactcttgtgtatctggactcgttcaccgtcgtacttgtactcgcacatcatgccattgggaaactttttaaaggccacctctatggacttgcactgggcagccaacatcggagccactgtggccatcggttcgtccatggttaggttcaacttggaagatagatttactcgtatgcgtgcaactttattagagtttttaggtttataacaatagcgtatataggtttgtttggttgtctctggttgaaatgggtctatgcttgtactattggttatacttgaatttgtacttgtgcttatatttgaatttgtacttttatttatacttgaatttgtactcgtgtttgtacttttggttatacataaacttgaacttgcatttgaaactagactggtatttacagcactggtactggtattggcactggccaagagttttacatcatctgttgtgtgcatctttgctagcattttaaagtactcggaaaaggatagagtattggaatttataggattataaagagtcgttggtagagtgttatttgtggacagtgtatcgagtttttgagtttgtacaattacactgcggtagagggattcttcaaagtcaatctgtgtattgactccggagcctttggtacttgtacctgtacttacacttgtacctatacttgtatttgtacttgtactcttacttgcacttgtacttgtactcttacttgcactattcataccagtaatatttacaacacttggactagcactcgccataccaatactgctcaactttgtgttcaacctaggccgactcttggacatggatgtgactgtagatgtaggttgtacaaaattgtcaacacagttggccttactgccctttggtgtagtgcatcgtaaagagtctatgggtctcagtgagattactggccgactacccagagtgtctacactaatgtgattgagtatagtgttgatggtgccagtgttggagctggatggtgtgttggtagtagagtttacatcatgttgtaaatcaccatcaacactagattcaaaactacactctacactacactccatgttacaatttatactacaatccatcactctacaatcttgtactttaccgctaatgctactactaccaacaccaacaccacaaccaccaatacctatagaatctaccacacttgcagtatccaccgagtccttgcacattttacatttgcaagatttacgacaccctttgtggttagacttggcttgtagtttgggtggtctcctttgcggttgcacgtgcacaaaattggccttgtcgtcagagtgcaagggattaaatggcaccgtattgtatggtatactgttgaagtttagattgttaaaagttgtgttacatgtattgtaggtggtgttgaacggcgactcttggaaatctaaatctaaaatagtctgtggtacttgcaagttttcaatgggagcactagtaatgttgttactgcacgggttgttaaagagtggcttgtccgggttattgaattcactggtattggaattgtatgcattggattgagagttattgttgttgttgttattattatgataaatgtatggctctttggtattataggattgtaaattagaattggcattataggaagagtgtgcattgtcggatatggtagtttgaatattattagatgttggttggtcgttactgttgttggcataggtttgatttatattaaaggatggttgatttgtattgaatgattgatttatattaaaggatggatttatattaaatggttgatttatattaaaggacggttgaggtgtatgatttgtattaaaagatgtttgaggtgtattaaaggactggtttggatttacattaaagacttgattgttgcatgattgattaaggttagagtcaaaagcttggtcgacatcaaatacttgattattattaaattgaaagtctaaattattaaaagtattgaataatgatagcgagtctatagcactgtactggtcgatgctatggttcataatgttggtgggctctacattagtaaacggtaaaggttccatataattgaaagattccacactattgagaggtaacgattccacactattgaaaggtaaaggttccatgctattgaaaggtaaaggttccatacaattgaacgattccacattattaaaaggtaaagactcggagttcaccacatctcctagtacattgtttgatgtacactctaccaaagaccaaggttctagagaattgtttatagggcctgtattgaaagtagtggtgcctgtattgaaagtagtggtgcctgtactaaaagtattacctcctgtactaaaagatgaaccagttaaatgattacccaacacacaactagcattttcaaactgtacactgtcctgagaattattgttagtattattggattgatgcaattgcaaattatgcaaagtcacatcatgggaatttattgcatcgtttgaatattgaaaggtaccattattaccattattaattacattaggtatagtattgtacagagctatatttgtacacgtacactgtctaaaagtagttgttgtagttgtgttgtagtatagcttgtacgggttctcaaacttgttggcatgtaacacatccgtaacgtcctgaatgggtctgttgattctatttgtgtttgttttactgccagactcgtagaatggatcttctaaaaaggtcgacgcattatcctctccgcactgtaggtccagtactagtttgaaatctttggacagttgaaacatcaagtatgcggtgggcgacaacgcttccagtatgcactttgagccggcgtttattttcaagtcgcgcttcattatacgaattagatattttagttccatagagttgcatcgtctggttatctcgtacaatagtgcgtgtttgccagtgattgaactgtcagccatgttgcttaaaaactcgtcaacctgaggcatcgtgattctttgtctctcttcttctttacgtacaaggggtctataaaaggcctcagcgttaacgctttcattgttgttgtaaggtttagatgcattcttgtcattagtttcttgcaaaagaaaattgcacttgtgtggtttattacactctctgtgaaacttgtaatggtgttcgttaaagaaactgattatagtctgagccacgtcgccggttctctccaagtctttaaacattaacgtttgtagcaattccactcttaacatttccaatctattcaatttagcaccgacatcgttacttttgcaattacagtaaaagcgtgtcaaatcgattccattactattgttgttactgttgttgactagactgttgaagacgcgagcgtacatttttaccaactgtctagtcttgagattgtacactctggggtcgagctggggcaatagcatgcggcaccatagctttacgtcgtcgcaatagtcaaagaccaccttgacgatttcaatcttttccgacatttgatcggttgcggctacgcgttcacacaagtgtgcaaagtgttctagggtatagtagtaggttggtttgttggtattgtttgagcgattgcttggatggttacttgtagaatgtgtataatttggaggatacttcttttgatggtaattttgatgatggttgtaggatgatggagtatagttttgatggttataggtttgattgtagtcttgcttgtagttttgattattatagttttgattgtagttttgatggttatagttttgattgtagttttgagtacaagtacaagttggaggatgaggtattggtaagttacaacaaatacccttgtaacaattgacacacggttgttgattctgattctgattctgagtctgagtataagtatgagtttgcgtctgattctgatactgttgattattcacattatactgattgggatatattgaatttgaatagttgcaagtccaaggtagaggattaccgtgatgctgagtagtagtagtatgagtagtagtatgagtagtggtagtaggcgtactagtaggatgaagaggtggattgtaaagatgcagacaaaacggcaacgatgtgtgcttggctagaggagcatatttagttgcaagtgtaggttgtttgaacaatctcttgggatacagtaatgatgttctgagtagagaattgttactgccactactattattggtgcttgtagttttacaaattgtgttgttattagtaaaagtagtggtagcagtagtactaggactagtactgatgctggtactagcactgatactgctactagtattgatattgctactagtactgatgttacttgtatcaatactagtagtagcagcattagcattataatcattaccaatcttaccacactttactggacaatccgagacacactttgaaaccattacactaggaccatccattacactaggaccatcactaatgtcactaccaatgtcactaccaatatcactgctagtctttgaaccggtagactcctttgcatgcctttttctgcgcaccctgtgttgccgatgcctggtgtcgaattcttgctcttgttgctggtgctgttttgtacaattattattggcaaactgttcacttgactgaccgtccacaatggttgattgttttgtattggattgcaattttctcaaattgtaccttttgtgttgagcggtggcattgaccgcatcttccatgaccgtgacactctgattggtaccacatcttttattcttgtactttttgtgttgatatgttttagagtgatttgtagcatttttgaatttcttgctgtttttgtgtttcatgttttcagtgtatgtaaatcttgcaagtgtaccaatttgtgtaggtgtaaaatataagtctagtattagttgtaagtagttgataatttataatttacagtttatattttatagtttatattttatattttatagtttgtagtttgtaattgtacaaataaatggtaactattattcactgtacactagaataataatgcaccgagtttttaatcagtcgcacacgcacaactcttgaccgccacacggtaaagtatacaagcagcgtatacgacatcaggtattaactctgccaatatatataactgtgaacaccgttaatactagcagcgcagtatttatcgttgataatattgtatgattttaacgaaccattaatccctctgtgtcacaaatatagagtctaggtgcactggctgctgctgttgctaatctgtcgcgctctatggcactacacctagtacagatcccattcaattttaaaatgcacaacaagcatgcgcaaataatcgcacccactatgtatttatttttacgatctcattttacgagtttcagataatgaacctgagcacgggtgtgtagaacaaacatccaaaggatatgattataaatgggaaatggataaatgtgggaaatggttaaagtgtataaatgcaaatataaataggattatctaaattggttactggttgataataaatttgaaattaatacagatggatataaatgaggggtatagagaggaaggtgtaaaatgtggagaagatcacaggaaatgcctaggtctgtacacatgtatggttcctatacttgtagttttatttctaccaatgcgcacctactacctatagtagaagtttatttccatgtataaatgtggtgctgtgaactgctatgatgtagtaccgtttattgaggaagtgaactaaaattgaaatgaaaccacttggctattgtttagagtctataattaggtgagcttacaatctcaatgtgtagtgtgtgtaggtaggtaggtagataggtaggtagggtggtaggtagataggtaggtattttagtatatggtcttttatcataggtaggtagttttatagtgactaaaaaacaagaatgtactcaattaggtgctttatttttcaaagatacaattttgagaatacatgaatatattaggattacattaggattacattaggaatacattaggaatacatgtaattataatatatatttgattaaatgagtattacagtctaatacatgctttatattttactctaacatcctactctaccaactattctaccaacctagtctacaacctaaactacaaactaagctaccatttaaagatcattgtgtggccatacttagtctcctactctccttattattacaagtgcaatacatctaaacaatgcatctaaatgatacatctaaatgatacatctaaatgatacatctaaacactacatctaaacgatacatctaaacactacatctaaacgatacatctaaacactacatctaaacaatagtaccgacaccgtacatctaaataaacatctaaaagtacaatacaaaactaggataataaatctcaacacaaaagtttggcattacaatccaaaacaaaggtattctaattaatgcaaattacacctctaaattaaacctctaaattaaacctctaaatcaaacctatgactaaaatgcaaacttgatgtcaactagatgttatacagtcaactatacactagatgttatacaatcatagatattacacaatcatgaaagatgttgtaattatacatcaaactagctagatattgtacagacaacattaaagcacaagaccaatagctaaaaatgtttacatggaataaaggttaatctatagtataaatgtagaaacttcaactaaaatgaaaaatcattatcacaccaatcgtacatcaaatgagactggttcacctttgccgtagaggctgcgctcacactgctaggatagattacattggtggccacggtaccggtgctcgtaaaactactgcccgtactgggaccgccgctctctacgacctcttcctccatagtgtccataatggtatcgtccgtgtccaagttcatgggtgcttcaaagagcgagtctttgcgttgcgcatactgcacaatgggcttgtcatcgatgagggcacagtcgacaaactcttcactcttgtcgagacacattacgttgctggctctgtgcaactttgcactagacggcatcggatgaatgtctagagaaggcagactactggtacaaccaccaccattgggatcggtttcgacagtgtccgagtgtaccggtatatagccagatggtgcatgttgtggttgttgttgttgttgttgctgttgctcttgctgctggtttatctcgctaccaaactctagatcgtcctcgaccaaatcaccgcctcgtgtatcgagcacggtaatgtacttggtgcacatgttaaacgaacctctaccgttcaataatacatcggtatcaaacttggactctcgggcattgttagtagtagtattattgtaattggtgttgtaatgataatttgcatcaccagctgtttcccgttggtttatatcgcagtttccgttaggatcctgctggccgatgctgtataagtatttaaactctttaacaatctttttgcgcacctgcaacgagtcaccgctatagttggcgttgtacgtttgcatcaagtccaacagtcttacattgtataaacgtttagttttgtgatcaatgttaaacagagcaaacatgaccacgcccggtggaagtgtaaacgatactgtatagtcgctcaaaacttgcatcgaatgtacaactctacactggaccttgtgtgtatttttcaactgatttattggcacgtgtaccgcagtcactcttgctccagatttgttaaaatagtaataaaagtgcggaaactgtttagcgcgacgattggcataacggtggcctctgttgttgttggcagtgttgttattattattgcctccagtactacaatgaccattgtttttggtactgtatggatattgattgtgatgttgttgttgcttatacaggctctgattcaaactcaactgattttgattcctcacacaattgtacactgcaccaccaccacgacgaccaccgtcaatgccagcatcaaaaccagcaccaccaccagtgccagtaaaagccgaggcaccgtaatcgtactggtgtcgtctgcctccatcgtccttggcaagcttgactctcagcttgtgcggttcgtttgaggtggttataaaaccgatatggtcactctttgaatcggccaacactcgtcgtgtacactttaacaaatccggatccacagtattgatgcactttagactgtctacaagtttgggagtgacgctaaacagagtctttgtacatttggcgttcttcataaacatgtagccattctcaaacaagggggtattctttgtctgtttcagtaaatcatgcaatgcgctaatttgtctctgtgccagcttggctactagctcgtaatggaaactcttgtaactctcaaatttctgatgttgattattgtgattgttattataaaagggtgcatgttgactctttttgattgcacccttgtagttcatggctacgatatagcgttcggcattggccggcctggacgtgttcggtttgacaacggtaaactcttcaaagtgcgagtaaatctcatagtacagattgagcatctgattggtgaatgcatcaaacgttttcaatacaaaattaccacccaccttgatgtgatcaaacgccacgtccacttgggctcggatcaggtcatagttgagcggctcttgtagattttcacggccacggcaatcgatcgatccatcggccaccaccaggtccactttgacgatgcccatatcgtgtcgaaagcgatcgcgatcgtgagcgttcaacaggtccacagtgtacaccttgacggctgccggattgggtagcttttcaatctgcaccggcaagtctcgatgctgtagtacgatgccaaagttggaccaattcttgtaggtcaggtactcggtaaaaccacctggtccagcgcacagatccataaacaggccggcatcgttgctcagtctaaagttgctcaattgatccatttcggccagtttaaagaagcaccgatttatgcacgattgcgatcgcaccatgtttatagtctcgtcggtgttgttccaggtcggtagttttgatttgcaattcttaaagacgcgctccttgagtctgacgagtttttgacgcaacgtactcattagctcgtcggccgagttgcaatcgtttgtggatgcagataccgatgccgaggtggagacggacgcagagatggatgaagcagatgtagaggccgataccgatgccgatgccgagttgtgtatagtggcattggcggcatcggtagcagtggttggaggagtatcattagtggccatagttgtagcagttgtcgcagttgttgtagtagtagggttggttgtattaatgttgttgattggatttaggttgcttggatttaggtttaggttagagtccgagccaacagcattgatcgcggccgttgtagtaatcgtaggtgtcgtaaactcttcgccaccaacaccaccaacaccactctcaatgcaggtactgggcttgcactccatgggttccatttttttgtctagtatttaaattttatttattcaattttattttaatttatttaaaaaccacaataatacaataggtagtactattagtaggtattgcagtccagacagtccacactggtcaacagcaaaagcactatggttggtgtaggtgttgtgcgcgggtattttatacttgtccgtttatctatcctatgactgtgtactacagcgtaggttgttttgtttgttttggtttcaaagtagcaacactgctatatacacacgcgtatttatacaaagtcaagtccatgtatattgggcgactcttgttttcactgcacagattcattaacaagcatggtttatactataaaaacagtaggtactctattatacactgtttgacttttttaaccccagtctaaaaaactagaaatgtacaagtatctagacatctccagtaatgatgtacagtggacagtgtgcgtcagactgaagtcagagtggcaaaagtttgtatgtaatgctatacatacaactactataatactactacatgtagggtggtgcacacactgcaaaactcccgtactcgcccggttctggtcactgaatggtgtgaaataattcactcgcttgaaattgaattcaaccttgatgcacacataaaggtggattaaaccatgtgtttaatgtttggttttagagtccaagttcttgaaagtggactagaggtttatggctagctgctgccggcatgtagagctactaaatgttacctatatatgcacacgtatacttgctaaatgtctaccactacctaccgacacctttacactcggcactttacctaatgtcataatctatgatgcacccatattaaaacaatactcttgaccattttattacaccctggttcatctactataaagttttattctctattgtgcaaaaagtacgtgcatgcgcacacattacaaaagtattattattagtagtgtagtaaggttacatcacacaaatcacacacacgatactgtaaaccatttataatacctacccacaatatcaatcctataaacctacacaacaaaagtccattgttaaaaaatacaagaaaaatgtttcataaactacaatactgaccggtgaaataacaccaataggctattgctttatactcaaacctgagaatattgatacttggccgtgatgaaaggttatgaaaatggccagaaggaggaggtgataatcagaataatactttgtgtcggtttttattaagagttgaacatttgttacattgttgcacacaattgcacaacactgtttcctttgttgttgtgtggggtgttgtggatggtgtatatgcatacctataccaaacagttgttttgtatgccaaagactagagacgtttagaattttggatagagttgtagatgtagatgtagatgtaggtgtagttttttgattaaaaaacaagtaattttttgactaaaaaacaagtagatttttacaagtgtttattttttataaaatacatttggtgtaaagttgtgatgaaaatattctcatttgttaaagtatcaactaatggaattttgtttaattatcaactaatggaattttgttaaattatcaactaatggaattttgttaaattatcaactagtggaattgataaatgaaatctgtttctatttctaacaacataagtatagagtacaaacataccagcaagtatgcatattatcgatcaagtatattacaagtaaaatatactacacttaacctaatgtgcaaccaacctctacaatcaaaatcttaacctctttcatattaacctataaaattaaaacacaacatacattgtttcttatccgcaattattaattaggtctaaagttatgcttgttcagttttagaccgtgtgtacgctatggtacagtttaaaactgcacaggcatttacatttacaaagtaaaacttttgcatttgatacactctgtacactttgcttttaatacgttttagataaacttgctttcttatctacactcgacactttgcgcttagcattacattacattacattattattatgatgtgcttatttaatcttctaggtcggccataaagtctgccattccgttgtactcttcgctgggttctgaaacaagagaaaaggtttatgattagttaaacagtttataaagtagagccattatgggtttattagattcgactgtggagtttaaattcacctgattcgattttacgtttcgcttcctcgtcggctttgcgtttggcttcggcggctagttcatctctaatacgtttttcctctgcaatacgtttttcctctgcaatacgtttttcctctgcaatacgtttttcctctgcaatacgttttcgttcggctgcttcagcatcggctttgcgtttagcggctgcttgttcctctctaatacgtttttcctctgcaatacgttttcgttcggctgcttcagcatcggctttgcgtttggctgcctcagcctccgctttgcgtttagcggcagcttcagcctcggctttacgtttagcggctgctagttcatctgcaattctttttcgttcagcagcttcagcctccgcttttcgtttggctgcctcagcctcagctttacgtttagcggcggctagttcatctgcaattctttttcgttcagcagcttcagcctccgctttgcgtttggctgcctcagcctcagctttacgtttggcggctgcttcagcatcggcctttcgttttgctgcctcagcctcagctttacgtttggcggctgcttcagcatcggcctttcgttttgctgcttcagcctcggctttacgtttagcggcagcttcagcctccgctttgcgtttagcggcagcttcagcctccgctttgcgtttggcggcagcttcagcctccgctttacgtttggcggctgcttcaatctcagctttacgtttggcttcggctgcttcagcctccgctttgcgtttagcggcagcttcagcctccgctttgagtttggctgccgcttcagcctcggctttacgtttggcggcagcttcagcctccgctttgagtttggctgccgcttcagcctcggctttacgtttggcagcagcttcagcctccgctttgcgctttgctgcttcagcctcggctttacgtttagcggcgtccgcatcggctttgcgtttggcttcggctgctatttcatctgcaattctttttcgttcggctgcttcagcctccgctttgcgtttggctgccgcctcagcctccgctttacgtttggcttcggctgcttcagcatcagcctttcgctttgctgcttcagcatcggctttacgtttggcttcggctgcttcagcatcggctttacgtttggcttcggctgcttcagcatcagcctttcgctttgctgcttcagcatcggctttacgtttggcggcgtcctcatctgccttgcgctttgctgcttcagcatcggctttacgtttggcttcaccatcgtcaacctttggtgtttcttttattgggtcctctttacgtttgggttgttcgatagtttttggaattaccggaggttcctctttgcgctttgactcttttttacgtttgggttgttcgatagtcttgggaggttcctctttgcgctttgactcttttttacgtttgggttgttcgacagtcttgggaggtacatctataacctttggtaaagttggtggagtctttggtggaacatctacaattttaggaaattaataataataataataataacatctacaatttaataataataacatctacaattttaggaataggtggaacatttacaattttaaccactaccagtactagagccagtaccggagccagagctaccagtaccagagctaccagtaccagagctaccagtaccagagctaccagtaccagtgctaccagcagcctccttacgactctcttcgtccaatttgttgaacgcattcaatagcgttgtagaagttatttcgtgctcggaagactcgtcttcatccgattcgtaatctggctcactttcaaaatctggtacaagtgagctgggaatagaaccatcctttggtttaggagtttcctttgctttagcttcctttgctttagactcatctgttgatttaggagtttcctttgctttagggtccgctgttgatttaggagttgcctttgctttagacttctctgttgatttaggagttgccttcgctttagattcatcctttgctttaggcttctctgttgatttaggagttgcctttgctttagactcatcctttgctttaggcttttctgttgatttaggagttgcctttgctttagattcatcctttgttttggattcatcctttgctttcgaaccctcaccatccttcactttaggcacatcagcaagctccaactcttttgcctttttgcgcttctcctcagccgctttggccgccgcctcatcatattcagcaaacgcgcccaaaaaggctttagctgaattgtttcgttcatcatggtcagtatattcgtcttcatcagagtcagtgtcaacgtctgtgtcaatatcctcgtcagattcaacctcgtcctcagtcgttttacccttgcctttgcccttgtctgtccccttgtctttccccttgtctttatcctctgccggtttggttttatcctcggcaggtttggatttgctctctccctctacagttttgttctttccctctacagttttattcttggtctctatagtttgattcataatctctagagttttgttctttccctctacagatttacccgtgtccccagccttgtccgtatccccagccttgtcctttcccgagtcgtcaccatctataaacatacaagagatattcattagtttagtcagtatcaaatcaagtagtgtaaatgttagtaagttttaaagcaagtgcaagtttgttagtataaagagtatagttgaatagaatagaatgggaagaatacatttacaattacacattataattacacattatataaatatatacacatatgcatacttggaaatgcaaaccaaacaaaggtaacccaatacgcgcatgcctctatacctacaccacactaccttttcttgcttcagtttgtgtagtttaccaatggttgtgtattttaaatacctgatcaaaataatcaaaacctttacaattgtaaaatactcaaagcaaaaatctccaagcaaactacacaaactataggtacatgcaaatctattataatttacaattgtgtacaagcctgcatcctgcatctacaaatctacattactaaaattgacaacattcaacaaaacaacaacacacactataaaacactacatcaaaaaccacccatttgatgaccatgcggccacttgcctgaaagtgtgcgggtgcctgtagttgtaccagtgtgccagtattgtgtatgtttttagtttgtactcttgtttttctataaacctatcatgtataccaaatcctatacccaacagttttaatgttctctctttgtatttgtgtgtataaacaaccatagtctacaatctaaaactagtaatgctactactactttcctttatttacactacctatattacactacctaggtatattatactacctatatttttacattctattttaaactatgcctccattttaaactatacatctatttcaaagtatacctccatttcaaactatacctctattgcccctccctctctagcttttccataattctactaggcaacgctgccacaaacgcatcgtaatcctcatcgggccgtttcaattctttgcctgaatcgagtaccattcgcgtgtacttgtacagtttgtcaaattcagcaatctcgctagagtctacgattctagatttgcgcctacgcagagcatcgtccacgacctcgtcagtgtcaatcgactcatccacctcctccaaagtgggaggtagaaccaattctacaatctgtggtgccaccgtatccatattctgccgacgctctctgccaccaatcggtgggtcctgtgtaaagaagcttcgatagtcaaagtctttgacatcgcccaaccaacccattattgacagaggcaacagcgatatgaagaaggacacgcacggtacagactcggccgaaaaggcgtgctccacaaacgtttcctgagtaaacataatgttggtcactataaagtatcgatacgtgtcatagtcaaacttggactcgtcgtactcgatcgttttaaacgaacccggctgcaccaccgacggtgtgactagaaactgtttcagctgttgactgctggctatcggtacggtaacgttgtagtagcgatcgttcataaacactttaaactctatcacggtaccgttcttgatgagtttaccgtcaaacggcaaaccctccaccatgcgaacgatgcccgtattgataaactcttcggtcacgtaaaaggcgccctttgtcgtcaacagattggacaggctgtacatgtccaatggctgactgcgtttgcgtctaaacattgcccacagtacgtgaccgtcaggtgccagttccttgtgcaccagatcctcatcgggatccttgaaaaagtacggtctattggtactgtagaatgtcatggccgacttgaacggtacccgctgtttggtctcaatgttttcatagtattctgaaaagacgatagccttgtcggtatcgctgaccgaaacgctaaccggattatccacgtctgctacacgattccactttttgacattaaacggcctacccttgaagagatcgtactctaaccacggcgatgcatagttgtagcgaatcgttataggattggttacaatcaattgatccgccagcagtctgagtgcttccagagtgccaacggtgaccatttggccagttttgtctataatcgaaccgggcactcggatcggatcgtcggtgagacgtttgcgcgtaaccgtatagtattcaccggatcgcgtttccagagcgtaggtgactgatcgattaccggtggcaatcttgtgaatcttgttgtctatgcacttttcgatagcgctaacgtacgacatgtaccggtagtcttgaatctccaacgctctgaaatgatgctccggattggaatcgtaaagtgctttgcaggccaacgacacgcactccatccgaccgtcgggatgcgtgtagataccgtcgcgacaagacactatggcctccgagtagtttatgcattttaggaaacgagtatcgtcaatctttagcgtaaacgtgtttggtttgtcgttacacaaattcctaaaagtacaagttttaagaatcttgctataaattagaccggctttgcacgatttgagtatgctagttgaattgtgacaagagtagtattcatattcgctaggcgtgtaatcgttaattttatcggcatgagtataaccgtcctctttgttttgacacacgtcataaaatacgcacggatcgctaccggcacggtttacgagtttttggttgtagactttgttgtttatacaacgaccagttttaattttgacttttgggttagaagttagttgatccctaaattcatagtcggcatcgtcgaccaccaccggttccgtggtgggtccctggcacactgcgtacacgcgcggatggtacagtgtgggcgatgaggcatccttggtcggcagacccttgattgtaccgatcgggtcgtcgacttgacatatagctttgggtttgcacatcttttccgaatctcgccagatccaattgtccggacacttgaacataccttcaatgttggtcactgtgaaaccctcatcggacacgttctctattagacccttgcgctttttggcaccgctggcgtcgtctctagccttgcgcttgttgttgactctaccgttgtcgaccgggttgcctagattgtttatcggcaagtcttcgtatttgcgcactagcttacccaaactgtcgacatagtagttttcatatttgttggtatccttgttgtagcgatacgtaaacgctacggtaaaggtgccattctttttcatatgagtgcttataaagtctgcgagttcgcgtggtgtcttaatcttggtggcgttcaacgtatgcaacgagaaccacatcaagatgacggtacaaatgcacaccacgctcaacgcgatcaaactgactagcattccaagattcatgatgaatacacgagttgctctgacacactagtctgaataaaacggacagcgtttatcatcctttaaaactttgcacatatacgcataacgccaatatgctcttacatgtagtctaggcgctgccattaaatggcgacttctcgattgtttgagattggtcacaaatgatttgacacgcacaatgctgctattgttgctggtcgttgccctctttgtggttattgtagagcgattagtgacaattcccttgtgcgaatattacaagaaaggtccgagcactgattctaaaaaactcaaagacacacccgacggcagactactagcgccactgatcgatacagtgtaaactgagcttgtgcgactgtgcaacaatgaccgagtacacatttaaaaactttaagagtgcaacgaccgaactgattcatctaatcacgcgcatgtacaattcaatgcagccgttgtatgacaaggctcagggtaaaataaactctgttcgaataaagctactgcgcgattctgtagacttgtacgacttgcattcctttttgaacgacgaatacagacacgcgtcgcgtacccttagcgatcaactcaacgacttgacattgatcaccacaggcatgaaatatgacacgtcaagttttactactctgagacgaatcgtcggtcgcaccctaaacatcaaacgagtctcgatacagacctacttgaactttgtaaatgtttacaacaaggttattgccgcatccgatagactgttgcagagtctggatcgagtacagacattgtacactgtaccgatggactttacgtctgtggttgtacgtggagtgcaagggggagggagtggtaatgctagggatgttggcaatctaccgatgcctacatttgtagagaatgtaggtcctctgaatactaatactaaaactaatacaaatactaataatgacaacaatccatcaaactatagtattgtagaagtgcctaatggaactttgaatgcaagaccactcgaacagattgaagagtacgattctagcaagtatgaaggtatgatggattatgaaaactttgcagccatggtggatcgtaaagatgccgactatctgaatcgaatacgtagcccagaatcagactcgaaattgaacgtggccagctacatggacggtgtaaagctcgagcccgaagagaccaagccggacgtgcacgtaatcgacttgctcaacacgatcaatgacaaactcaatctaatggagttggccatcaatgacttgtcgcagactatacacgaaccagtcaagggtaatgatgatgatgtgggtcaacaccaccactttaatgatgcactccaggatcgactagactcgatggccaaatccaacgaaaagcaaatcaacgcgttagaggatcacttgactcgtttgattgaagagggtaacaagaagagtagtggtagtagtggtagtggtagtagtagcagtagtaacaatatgcctaaaattgacgctataaaggctgccatacaaactagcctggaatcgtatctggtagactatatggaaccgctgctggatcgattgtcggtacgcctaaaaaatgtagtcaatcaaaacattgaaaactttatgcaggcccttgtggagagcgaaaaggtgcaggatgaacgctaccgaaacttgctcactcagaacgaggaaattgtcaagtttttgagcatgttcaactttgagcgtttacagagcataatgcaacaggtggtggacggagtgcgacaggtcggccagagccagataccgcccgagcagatgcgtcaactgttggacgagctcaaaactctgaatgcatcgcagcgcatcagttcgattcaaaccattgccaagttgcagaatgcactcaccgtactgggttcgatggccgacactgaggcggtgcgagacttggaacgactgctcagagagctagagagctttacactcagacaggctggcgttgtgacttttgacgagttgcaagcagccaacaccaataccgaagattggtcattatagtgtttgtagaagattggtcattatagtatttgtagtggtgttgggggagattactataatgtgtatttagagttatttagagtggtagtgtgtttagagagagggtttgtattgtatccagagtggtagctagttaaggtataggattgtgtagagactttagtaacgtgtttaagtaatgtatttattaaatgggtgtaggtaatgtattcaacaagtgtatttaggaatgtattcattagtattaatattttttggtatacaaaaaaatacaaaaatctacaattcacatagtgtttttattaagtttaatttcaaatacaattacaattacaagtacaattacacttgttacaattacactttagatgcccacaaactttaaagatcccttcaaatgcaaactacaaatcttacaactacaacacaccttactctaccttacacaaccatactctacaattaaacatttgaagcatacgttctaataaacactttatcctcatcctcattctcatcctcctcctcagactcctcatcaggctcatccgtaggctcattcacaaagtcataatagtcgactctaatcaacttgttgttatcaaccaaacggtaaccctttggaagaatggttgaaatatccacctcctttggcttgtgctctagaggcttcaattcatcctcagactcggattcatcggtactgtcaccatagtagtccttcaaatccaacgcattcggcatttggtcagattcaaactcttcctcactgctgcggaaacgcttaatgttgtacgtgtactcgtcagaggtgaatcgacgcttgtttgattgctcggtacccttgaattctttaccctgtgactctttttgattttcatactctttctggcacttgttgtcagtgctattgttgcaatctctagaaccgttggcacctccatcagagtcactatcgtcatcgtcatctgaattgtgccctctatacgcatctggatcaacatcattggaatcatcgtcctcatcctcttcgtcttcaatctcttccccgtcactgtcaatgtttacgtatccacgctgcgatctgcgtttcgtggactggtacacttcgataatcttactctttagaatggagcccaaaaaggcatcggccaacgagcccagtagcatagactcttgggcgatgatgctcttaatctcggtcaagtgatcctcaaagcgctccttggaaacgtgatcgccaatgtgatcgtccacgtactgtatgatgcgtgcaacgcactctccagatacacggaatcgatccactagtatgtgacgagtgtcgttgataatctttagaataacccaccgatcgataatgtccggcagttcagtgtctggtgcacttgaaggtgccgaatagttgaacatggagaggaaagaggacatggtgcggtttagagtttagagattagagattgaaaattgcaagtatagatgggtagagggtagtagtagtagttggtagtagtagtacgagtacttggtagtgatggtactctaaccggtatagtggctcaaccagtactgatgactatccgctcaagtctactgtatttattgcacggatgagtatagataatacgctatgcgtaataatgtttataccaattcaacacgttgttatcggtaaccctagagttcaacaataactaggtctttctatgttttaaactaaacacgcatacattcaaatttagatggattttccatgtccaaataaaggtacagttttacaagtctttctacatccaagagtaaatgtttaatcttaaaaaacaagaattcaacaacttgaatttgagtctatgcctaaactctacagttacattttattgtcatctaaagtaatactactatcaaacgtctctataaatcaactttatttatttaaacaaacttttaaagtaatttatatctaaacaaacctctacctttaaaataaactacatctaacacaaccctctaaagtaaccttctaaagtaaacctctaaagtaaccttctaaagtaaacctcaaaaacctctacattctacaacaacatatcctcactctctgtactctcacccctagacttggatctggaacgagacttgggctttgcgttcaacggtacggccgtgttgaatgcaaaatctttgggcggtggtcccatgctcaagtctgggctctctggtcgagtcttgggtgtggatagtttaaagggcttcaccgagttggtcttggccggtggcatcagtttagtcaagattacagacattacatttgacgaaaaccaatcgctcagagtgtttgtgtgctgctgcaccagagtccatgtcgtccacaggagcagtattataaagagcaactttataatggcgtgcatggacatggagcccaatacgacgccgatgagacatcccgagattaccaatgcacagttcattttgatggcgcctcttagactttcaaccaaatatagtaccaatacggtattagtgttggcactggtacattgatacttttaaagcaatcaaagacttgtgtacttttttaccatttatttccattcatcaattcaacttacaacaacaatagagtgcttaaaaaactagactttattgatttcaaaaggttacaagaggtttaagaatagttgctaaatacatagagtgcatgcaaacaatcaaacataatactaaacatgtacatttggtgcttacaataatattgcttttacataacaaatttctacgagtacaatttacttgaaaaccttcatcgcctttgctgccaaataggatagaatcggatactcagagtgtctatatttgtacacgactctcgagttgcgcatcttgttttgcacatccgtcttggactctttgggcacaacggtggccacgctggactcgtcctctgagattgaagtgtccgagtcttcagtgtcggtggttgtttcggtaaaattcatttcggaatcggtcgagctcgaggaacagctgctctgcgagtctgcagtgctggtactgctggcactagtctgagtgctctttgatgcaccgttgccgggattgctactgttgcttttgatctcgacactcttggcctcgctctttacgagcacctcttgaaagggcttgctgcgagtattgtacttgtgcatggcagagccatcgtccagtctagactgtttggctggcggctcctcggactcgtccaccattggacggtggccatagtctctagtgtacgagtcttcaatgtaggaaccgcgacaatcaaaatcccggcttatgttgtcggcgagagcgttgtcggcgagagcttttgatactttgtagttttcaacgagtttattgcaaaacgtattcgtcagtatagacatccaatctgcggtcaatggaaacttgtagccgacatcaatcactggccagtcacacagcgtggccagtgtgccataaatcacattctgagccttgacatacggtacaatcttgcaacgaaacaagtcaccggtaaccttttcgctcttctccagagtgtcaacgcctcggttaaacatgcgttttctattcaagagtatcgacgagtcgaccagtacaaagatgggaaactttttcataaactctagcagattcagattgagcgtgtgcaatgccttgtaggcgccctccatcagttcttgatcagaggacgcgtcaaacagtgacatgatgagtttccagattatattgttaaagacgcacctatccgtgacgctagtagagtactcttcgcaggcgtgcatcaacactggcaggcattgcataccgacgagatcgttaatatccttgtccttaaagccaccgtactgagacagtttgagcacctgaacggtaccgtcaaaatctggccccaggctcttttgagcgcagcttgtaatattgcgcagaattgtactcttgcccacacacgcagtaccgttcaaagctggcgatatatttttagtgtgctttacgaatctagtcagagtgtcgtcgctgatgcgatcggtgccgacgccacccgtcgtatacgtctttattacgctcatcaaatagtcgcgagtgtaaatcttgtcaatatccatttcgggaagagtttgccccaggctaatctttggcctatcaatcttgtaacgaaccagagactctgccggtagcggcatcgatagaatcggtaaaatcgtatcgttccacggcaccggtccgaacattgtgtctatcgtatagttgagtttagagttgaccagaagcgtttgaaggatccgcgacacgtcaatcagcaaatcgttggcagcgatgcacttttccaaatcgacaaccaccgtctcaaagaagcacattagcgcgtacaagtccgagtttgggtgcagtacgttaaacgagcgatacttgaaattgacatggtagaatacttcgcgcagagccggaggcagacactcgggaccatactctaggtcacagtctctaaattcgacaacattatgtacgtattcgccatagttgcgattcagtggctttacacacgagtaccgattgatcagatacacggaccgattgggctccagttcaaatttacgacgcacaattaggctcggttggagttcgctcgaaacgagatccaaatcgtcaacgtccgtgtattggtacatttttcaagttgatattagtatatgtatagatgtatactgtagaacgttcgtacaacgtttgatgttcaacttataaacttgtgctatttatattgcccatagcgtattgttaatatttcaacataaaatgtagtagagataagctttaaaagtacggtgcacgaccactatcagtaccagtggtgtggtgcaagtccccaagacaacaagtctgatccaatttaatttttggcttttgaatcaaccatggcctctatatctgcatcctctacaatttcctcatcatcctcctcctcttctgacgacgatgtaaacattactcttgaagtggagttggagaggatcaataaaatttgcaatgcagccaatgcgttcgagtatcgtcaaatcgagtcgattcaatcgctgcggcaactcaagcaactgatgatggagaatgtgactcgttccattgtagcgtatcccacctatcagggagagcgcataatcgactacattgtcggccctcaaactctaaacgaaacgctaaagtctaaactgagcgaggtcggagtctcttggattgtcgatgccgaagacgagtcggcaatgaatcgcaagactgaatggctcgccacttggaacgagcacctaaagagcatgtctaaactggaaacgtgcaaggtgcactcatcggacgagtgtcaccgagtcaggatcgcaatgattgtcttttccgtagtgtccaagtgtttgaataatcgcatctgcaacggtgcatccggagcctcggtttccaagctcgtgtacaacaagtgtaccatgctcgtggagcgcatggaggactatgccaccgttacaatgaaccatcccgaggtggctatgaccaatcgcaactatggcaacttttacaatgtgatcaagtcgtgcgatctgattgtcgtctacgatgctcagaatctggtgcagagcaacggctacccttggtacgatacctttgtggagaatgccagcaagttgtacctgtgcaaagtctcactggttggaagctgcttcaacaactatccgtgtcccgatatggacattcattaccgcaatcgatgcgttcattgccgcgtgggacatgtgtttcattcgatactgcatcgattcaacttgggcgaatgcatgcacattggcgacagtgtactgaggagcaagaatctagaagacgagtgcaatgtggacgtggagactgtggacgatgaggccaccaatctggccgataaactaaaggaggataccgatgaaaagtacaatattgaaaagtgcaatgaaaagtacaatattgaaaagtacaatgatggaatgtataatgaaaagggtatcgagactcctagtgtgattgttggccgagttggttcaggtttaggattgtgttatcgtggctataatggcaatggcaatggaggtggcagctcgtacaattacaacaactacaattacaacaatggtaacaactttaaaagtggaaacaggtatggtaaccatcccaacaattctagtttcaattgcaatggtggctcttttgattcaaactcttttaacaattttaccaatccaaactcttttaacaatcaaaattctttcaattcatttaacaactcttttagcaactcttttcccaattctggatatcctaataatggcaactacatgcaaccgactctttgctcttgcaacgattacaattgcagctttagttcaatcaattacaatagcaacaataacaactcttttccaaactatcaaacctgtaacaattatccaaacctgtattccaattcaaacaattattataacaataataacactccctatccgtgtccatttaacaacaacagcaacagcaacgccaactatccaaataatgcaccttttaatgacaatagcaatttcaactacaataataactataacaacaattataacaacagcagctattccaacagtagttataataacaacaactacaacaataactacaacaaccccaactttaacaattcattcaatcatccaaattcttttaatcaaaatcaaaacaattacaactcctacaaaaataccattagcaaagcaccaaacagatctgcttttacaccttacaaggcgccctataacaacaatcgtagatacaacaacaataataacaatactaatggttataattacaattccaagttttacaacaacaacaataaccgatatgctagaccgtacaagtatgatagaccacagtcgatcattaaacccattgaagaggataatgaaaatgttttgaaagagccaccatgcaacacttctacaccgttgccaatagagccgatacaatctgatgctgaatcaatcagcctagactatagcctagattcagacactccactgcacatgttaaagtgtgcattggaacaagagctagctgaggatgatgatttggtcaatttgtctgaggttgattataatgaggatgccaatgttgagaatgttgattgtaaggattccaagggtagggattctaaaggtagcgagtcaaagtgtagcatttctaaaggtagtgtcgattctaaatgtatggattatgaaaatgttgtagagagtccaaagagtgatactagtatcgagaatcattcaaagtgtgtaaagagttcaagtgtaaagagtccaagtgtaaagagtaagagttcaagtgtaaagaatccaagtgtaaagagtccaagtgtaaagagttccaatagtgacaaaactaagcattccgagtactcggattgtaaacctgaatataaacattctgattctaaatattctaaaacctctgattctaagcattctatttctaaacattctaaaacctctgattctaaacattctgaatccaaacactcagagtataaatatcatgattacaaacactcggactctaaacactcggacgctaaacgctactctgactctaaaactcttcctacatccaaaccacattctgcatccaaatcacattctgcatccaaatcacattctgcatccaaatcacattctaaatctaaatctaactccagacaccactcttatgaatccaaacatgagcaccgtaccaccaaaccaaaccatagagtctacaatgacaaagagtcaatgaaaacaccattttacgattccaccaagggtgtcgtttcggagcactctgtcgaacgcgagtaccatactgaggacggctacggtaaacaagagtacgattgcgatgaccgctcgtacaaggatcacgccgagttcaatgacgagttgcatcgtaaacgcagacgatccactactggttattctaatgctgaacattgttatgataataaggcttatggtaattctaaatgggtcaattcaaaggttgagcatgcaactaatcaatacaacaacacgcaatattatgatgatgatgctgatgacaataatgaggacagtgtacaacagtacaaggatacgtacagagccaattgcaagaataagcatcaaggctacaagaacaagaataggtctcactacaagagttttaaacactcgtacaatagtaacaacaacaaaagcaaccacaataacaataacaatttgtacaccaagccttgcactctaaatcagacgtatcctacaacttttaaagttaagaattataaaaagtacaacaagagtagcaatagtaacactaacaacaactacaacaacaaccacaacaaccattttaacaaactgaaaccaattacacgaccaaagctgaatcgtagactgccagagattcaggcagtgtggcctgttgatgtgccagctgatgaagaggaagaggactttgaatacacatacactgagaccaaaactagacacacctcatctaaagggtctaaaaccaaatcagtgtccaagtccaaatccaagactgtcaaacgttcctatgtagactcggaactggaagagggtgagttgtgtgatgatgaagagattttaaatttgttggatgcaccacgtaaacgcaaacggcactctgttggaaatttaaagtgcaaacgcaaactgagctttgattgtgatccgaaaaggtcaaggattgtgcatgattctattattgaacacgatatcgacagagaggaatctgggattagtaagggatcgtacaaagatttggatgctgacttttcacatgtagatggattgttttaatggttttgattgtttaagttttaagttttgttttaagttttgtattaagttttgttttgagttgtgttttagagttgaggtttgagatgtatgtcaagttcatatttgatttgtattttagaataaggttacgagttgaggtttgatctgtattttagatttacgtttgttctgcactttagagttgtgtttattctgcactttagatataagcattaatgttcactactacatagtttgtattattaaacaataaagtatttttttgttatttaaaaaaataaacatttaaaagtaaatgcatctttttcactgtactactacttccactttattactacgtccaccactaccactcctaccctatactactacaacatactttaaacctttaaatcctttaaaatccttcaaaatcctttaaaaccatttaatccgagcattattcacatttcattttaaaccccaaacatgcacacacaatctgcattcagcattcggtttattaccctcaagtcttgtgtgcattttatagacacaattatggtaccccattcatgggttgctttaaattggcataatatttgttgtttgcataaagagccgttccaagtaaaattacccgagctatggtaattatatgattgtaaagtagagtttacggtcacgaataaatgctactgtagacttgcaagtctcagagaggtgtaataaatgttctttttgtttagatgctaaaaaacacaaatcaagaatctttgtatttattgaggtattctatataaatcaatttaaaatctacacaaattgaaagtacacaaattgaaaatacacaaatctttaaattacatttaagaaactcctacacaaataatcaaacagtaacctccacgcacacattgctctactcgtcactctaggatacaactttcaactacaacctacaacctttaactctagcctacaactaccaaaacctaaatctctcaaacacactccctaaccgaaagccgtcaacttggcaatatcgccttcggcactcttcatcaattgtaccagtttgggttgcacattgatcactgtaatgttgccattgtcaccaccgccaccatcattcttggcggctatgcgcttcagatcaatctttttctcactggcctcaggttgcgccttttccaattttatggcattgggtgtggaatggctcattacaaacttgagaatctcctgaccgcacattgtggccgcagcctgacacacagactgtgcattgttcggagtacgcacaatgggcagtcggactcggctattgctcgtattgcaaagcatcacatcggacgcttcaaaatccaaatgggaaacacacacgctacgattaaagttgtgctgaaccgcctgaatgcaccgatccaactcgcgcagctcctctctggacagaaaggttctgcgactacacacgtactgtttgtacgcattcagaatgcaaagaatggtggcgttgtgtagtgcaatgtttttggacgcaggcgctacggcaaacgtttccagcgcctctgtgcatatacacttgtagtcggtcagaggtctaggtgtcggtataaaatgctgattcaatttgttggactgatgcagcttgctttgcatcggtttaatgtgcttgtacatgatgccgttaaaagttaaagctgaataataaaatgtctgaatttacctatagacacgtaaagtttgcaaagaccctactatattctacagttttacaacactaataagctattactattattatttattagaattaatggtgcaatattactactactactacctactagtacaaataccaacattgacatttcaagtaaacaaagagtttaaacattcaagtaattttcagtctacacaccaaatggatctatgcattcaccgcgtacgattcgtccaccgcattcaccctcctttatacgcaatgcgtgatacttgtcccaatcgtatcgattctcggcagtcaacatgactagcgatcgatccattgaaaagtcaaatctaaagaataggaatcggagcttcatagtttcatcgttaatctttgccagattcttattgttcgagtacacactgagaccgttgacctttttgagcacgacaaacggtttcagattcatgactgtatagtacgacgtccggccccacagatagtacatggacagcatatcgtacattagattgaacgtgtacggatccaggtactggacaaagccactagactcgggggccggattctgcaatttgaaatcgtacgtccaagtgtactcgtacagtttcagattgggcaccttgtacaggcgatcggtaatcttaaagttgcccggaaactttacctgatgatagggtcgaatcagtagcgtgtactcgtccttgtcaatcttgagcgcatcgaaaaactctttgttgtcgtctcgggtaaagtttatgcccagcgtgggataggtggtgtcctctaggtagccgtacacgtctacggtgtagttggaaatggccaaaatcgcatcgggcccctcatcgcctgccagtaggcgctcgtctttgaatctgcgtatgggcactccatagtgttgcgagtacgtctgacactgaacgctaccgtccttgccggcaatgatggctccgtccaccactaggccagtgacgggacacacccggcacggattcggtagactctcaccggtgtagttggctgcgatcgttttgtggtacctctgtttggacacagagccgggcactatgggctcggtggtcggtgtcatgttgtctatcgatttaatctgacacgttggcagtccgttgatgcgcataaactcgaaattgtcaccgcactcgcaaaccatttcggtgaggggtacattaatgtctacaaccttaccgttgcacacaaagggatcctcacacgagcccagcagacccagattgcccacgtagcccggctcggtacagacacacaatagattgtagaatatttgattttcatcctcgggctcgttgtaggcctcctcgtccaagtccctattgtacaagaccagtgccagtttgccgtgattgggattgcacaagtctacaacctttttcacactcagacaataaccgtcgtcgagggtcttgctcttggccagtttaaactcttgaccggtttcggtgtctgtgtagtcggtgtcctcctttaggtggacgcatcgtgcagtcagattcttacagcccatgcacgaagtggcatcggacaatttgcattctttaggtttactcggagtgcactcgtaaagattcgtctgacccggatctatgattacgggatctgtagaggggttcttgtatttaatgttttgaaaggggcctttaaaccttgttacagtgttgctgggttgtaaattagaatctttattagattccgtgtgcttggcctcgatttcgctaatcttgaatttataacggccccatgaaaacttttttgtttcatcattgtacttttcaaaactcttgcgtgcacactctagtaggtaggtcacgcacaccagtatgagtacgagcgatgcaatggtaaaaaactccattgaggcagcgtgcactggtggtgcgttcaagttttggtttgtgtaaaaaataagacttgaactcaaagagttgacttactaaaaaacaaggatttttattcatcaaaatactttataaaaatcttgcaatccataattgatacaaatgttaaactaaatctattagctatactaattgactctacattaattgtacgagtacactctacattaattgtacgagcaccctctacaatacttgtataattacatttccaatcaatccttatccttccaagttgcatgtgtcactgctcgcagacggtatgcaggaatcatagagattaccgcttcgattgatttatcattacccataaacagaggcggcatatcagactcgtagtaaatcaccacgttaatgtttaattttgcatacagcgatctcgcatacttgagcaggtttataaacaaaccgttgcgattgcgagtcatagtcttttcgtcaaacttgaacggtggcgtagagatccaagcgtaccggtgaatcttgtggccatagtacaattgcatgggattcgtcagagtgaaaccctctggcatgtttttgataaagagttgagcctctttggtcaactcttcaccggacaaaatcttgcaatccataatgctacaacaatggatgtcgctcagatggattgtagacaaacttgttttttgacaaatttatcctatttcgagccttggcactctcaatggcaatgttcaccaccgatagcgcaaaaatggtactaaacgatatccacacgttcatagttgcatctgcatgttgtttctgtaaagtatcgttgacgcataccgttaatagtctattgaaattaaacgcataacaagtattgtagtaataatcactagtaggtgtttaaatggagcatatataaactgaacaaattcattcaggttttatcaagcattcgcgttggtcgtgtgcactagtctttgtactagcctttgtttttattgcaacaatatgattcttacgattgtcggtgacgattctagcgtccgagtgtctacggacactttgactgcaaaggatgcgcactcgctcatggtgcaagagattgagtggaccatgaagcgcaaattggagtatccagagctgtcgctggagacggtgctctctgcgctgtatgctacgagaaactttttggacatgaatcacgcaccgattcggatgatggatcgcacctactacaatacaatggtggacttttccgatagttcggtgccggtcattgtgcgcaagactctgtacaatggggacaataacaacattgagtacgatgccaagattgtactgcaagaggacaaggacaatgtggacgagtacctcaagtgcagctacaaggtgtctcgagagatgaaactggccgagcccaccgaatcgatggtggtcaccaagaatgcaatcggctactactttatcaccgatggcaatgtgcgacacatgattcagtgtcagggtggcaggcactcgtacaagctggaacgagaggtggaatcggagatggagctggacggactcggtgcaaagattatcattcgtgaactgaatcggcatctggccatcggtaccgagtttttggaacgagcctacatggatcagccgttggatatacccgagtactatcgtgatgagattcgtgacattgtatctaaaaatgttgaaaattgtatatagtgtgttttgtaataaagtatacccgttgtattttttagacacatgcattgtacgacttttgatacatttattcatggatagcatcctagttgaaaagggtctagttttacacaagaagagaaaactcatcatgtcagccactcctagctcgtcaaaggtgcccagcgaaactcccgccaaggaagtgaccacaactacaatactgtcgcagttttgctatcctacgctcgtgattgtaccggtggccatatcaatcattatattgatatttgccgagcttacactgttttacaagattgccataatctgcctgctggcactgactctgtttatgtactttacgcagcagacaaattggaagctgttttgcaagactggaaagagtgcgtagaggtggaggaggatgatggttaaggggagtagggtggtagagtatgtggtagtgtagagtgcatggagtgtacgtgtaatggattgatttatggattttagatttggtctttagatttacattttaaatttacattttagatttgtctttagatttacattttagatttagatttattacattttagagttcttacattttagattatattgtactgtattacactgtaaacattttgtatttttgacagtagactctttgatagatggatagatagattacccacgacatagtttaacaatacttgacatattttaacaatactaaaactctttaataaatacctatacaaaagtagaatctgtttacttatttttgagacaacctcaccgaaccttgttttatttttttagcaatgcaaagcaccgacacggctttgtatttagtttgatattaaactagcactaaacttgtaaccttgtagactcgttactctatagagttgcctatacaaatcaaatggaactacaacaacaacaacatcacaaccaatcccagtattcccagcacacgtacgagcatcgagtcaggtacaatgaactcgtctcatcggtgggtgtgcatcccaccaattatgacatgtaccgattgagcaagactcgacactatgccataccgacgctggcactcaatcggctactggtgcgagtactggcccagagcagagccagcctagtaggcatcctgcaacgcttaaaagagtcgttgcacgaaacatcctccactctagagtacccactaaaagtatccaatctggcaaagtatacgagtgccgtgatccaagagattaccaacctccaccaagagactcctatacgtttgaatgaattggaattgtacaatctgtactcgtgccttgcaaacgtaactttggactcggacgaggatggcactgttcaaacatgctcctacaaaaacaagaatactacacctgccttttatgccgactcttgtacagacattgcactcaactatagattgccctatgtgtttgatgaaaagcacgatccggaatcgttgcacggtccctatctgacgctgaatccaaacgtgtccctagtcactgcagtggccggcgttagagccctgcccacggcaagtgcacgattcgtaatgttcaaggctgtgctgtacaagtgcattcaactggaccgacagactgcatcgattgacgatcgcattctctccaagtttgagtgcatcttggacgatgccaccgagagctacgattcagactacgtggacgcgttcctagacaatgcagatgctcagcagctagatcacggctactgttacggactgatgcgtgcgatcggcaccaatctgcccagagggcatcgtaccgagcgcaacgtcaactactctagccttttgtactttctgagcgtagactacaacagcgccttgctaaagtgcaaacccaaactcacccggtccgattgcgagtacattttcaaaaggatcgtcaagggagcgcccgagtccatggtgatcgataggtgtgcctataccgtgaatcagattgtaaagtgttttcccgatgtgggcacgtacagtgtacaagtgtacaattcccaagaggacaacaagagtttgaattttagagtcaacaaaaacactatacacttgctcaacgagaaccgagtgtttgaagatcgcaccaccgccaccgatgaagaggcgcgacccgatctggtgttgaatcacggttcgacgcacggtaccgttgtaacgtttggtgagcacgatgcagagttggacaagatatccagcgacgactattgtgccctgatggagtacgcccagacactggtcgagttgacgtttagatttggcaactttgaagtgctccagttggctctgcagctggcaccgtacaacatcaaagacgccaccaacgttcaattgaccatgactcgtaccaagggtgatatcgatgctgcactcgtactcaaaggactctgggaaactataatgggcaagagttgtgatctatcgtacctgtttaacattttgtgcaaaaagtacaaacgtacagaatttgatgaagtttccgctgccaatgaactcgtcaagtttgtactctttgactgtaatcgaatcaacaatctgccggtggatgtggaacaggcgaggtatgcctacgagtctatacgcggcaacacaccggacgtgacactctactatgcaaccttctttaggctcaaggaattggaactggtcaaactgtaccattcgacaccaccctctgagagagacgacgagtttatgactgtgctaaaggcactctatgtgacctcggtgcacacatcgcctctgggcaaacgtctagtgtgcttgttaaactttgacgaagacatgctacgattcgatgaatcgctcaaagcaaaactggccggtagactaccctttgcaataccgcacattgaggatgccggtgcactcttggaggttgatagtgatgctaacactactactatcaagactgatgatgatcaagctgcgctatatgtagacttttacagattcaccaatgtcgacaagagttcaatagagtcggagctcgagtaccgaatctatgcagactactacatcaagactagggatcagatggtggcacatttgttgtaggttagtttaggtgggttggattgtttaatgtagaggagagtggatgggatgagtggataggatgagtgggttggattgtttaaggtagcgatggatgttggttatagaggttcacgtttgtagagattaaaaaatattgttagagttttgtgttttattgataaccatacatgtacatttagaattacatttagaagtacatttaaaattacatgtaaacttatatttaaaattatatttaaaattatagttaaaaattatataaagacatactattgtatcaaaaaactacatttattcaagtaatactaatgttatagaatacatattacagaatacatattttttaaactcttattttatcaacaactctacaaatcttactacatacaactttagtacatacaatttttaatacatacgaatatcaatacatacaaatgcaactctgaatacaaaaaccctccatcctattcatcatcatcgtcctcgtcaaaggtaaagtcaaacatgctgcaatccaccttttgcactcgtagcgggtacagtttgattatgttttgatctccatactgagacgacaactgaggcgacaacattatggaatcaatcagaatggccacatttccagacttgcgaactccatcgtttaccatgaagccattcttggctcgctgataggcctgcagtgtttgaacctttttgtaggcacaaatcttgaccacgtccgatagacgcaaatctacaccggtcacttggttgtttacactggacacaatcatgtccctggcatcgccctccagtgttagaatctgcgccgatgccgcatcgtgcatcttggtaaagatgaacaagcgtttgccaaacttgaactgagcccccatgacgctaacgttggaaatgtcaaatttggacattttacactgcatcgatacaaacttgagattctcctcactgacacacgacaccttgccgcacgtctcgtccagtgtgccaaacgcatcgttgatcattttgagccaagcctctacgcgttctttgcgattcatctcggccatctgatccttgctgactttggactttttaccaaacctacccaggcagggacgtttaatgtctacgcgtaccgagtccccacagctgctggtcgcaatcgttataaactcttttagcttgagaatggcgtctgccgtgtagattgataaaaagtgcagacaccattcgataaactttaaatcacccgtattcgtaatcaagtcttcgtacagattcttgtagacatactctacggcatggtacagtaccttggtggcctttttgccctcgtcggtaaacaaatgctccacatccaactgatgcagagtctcgtgattgggatcgttcaattcaaacgagccctcctccttgataaactctaccagggcctttttgaaatcttccaattgcacaaacttgggtatgcgcttcacgtgcggcggtggctcgatgagtttaatgtttttggcaaaatctacagtttcggcagaggccgcagggaccgcatttgacgagtcccagaggctctcatcaaccttggccgagtctcccatgacactttgcaaatctacagatctcgcactgggcatcacgttgttacccatcatggcactggctggcctcttctgaggagccttgagtgcagattcaatgtttgtcttcatcatgatgaatacaaagttggtagtactagtttacttgatgctacaattctacgttagacaataccgttatagttgcaataccgtattgtactaaatgaaattttaaatacttcgatatttatatacactagtggtatacagccatgaatgcgtcactaagccggtctcagcgcgttatcgaaattgtacgtttactgcactcggtgcgtaaacgtgacattacacaagacgatgtagatcaattaaaggctctaatcaacactcccgacacgcgcatcaatagggccaattttgtacaagtggccaaactgtgcatcgtcaacggtcagcgtaacgtaaagggatgtcgcatgattacaaacggagtcaacgatttgccagacagtgttctaggattcattctaaacaaaccgatcgccttctttgaagactatccaccgtacgagaacgcgactccctccatgtcgattgcatgcctccgaaagaccaatgccgcgtaccactgtctaaactctagtcaaaaggtggcctttcagattatacacaaacagattagcgatagctttagattggacacggcatcctgcgtaccagagagtctagacggcaagtatacaccgcccaagattcactcgatagaagactcctttttcggtgtattaaactctagatcgggcacgggcaaatccacaattatgggtgtcatggcgtgttcgttgctcacacccatcatgtttgtagtttatagcaatgcgctcaaagacgatgcggccactctgcacacaaacattaatgctcgcaccacgtgcaattttattatgcacactctgggactctcgtacaaccaggccaagtgcatctttaacgcaccccagtcaaagacgatctgttccatattttacgatctactcaaattgctcaagacattcaagatggtgccgtgcaacgatggcgatttcgcgataccgtacctcattgtgtttgacgagtacacggtcatgcaaccgctaatgattatattcctgcacatgctcagtaggcagtataaactcaacattttgatggtgggcgatgccaatcaacaaaaggccatccgcacctcggtctatcacaaaatgaacaatatgcatctgctcaaggagctggcctcgttcgatctgatgctaaccaaacagatgcgcatcaccgatgccgactacttgaaaattatacaaaccatagagttgcacttggacgagaagcacgacaatatacgcatggatttccatgaaaagtatacactctactctttgctgtatagacactttcacattaacgagtgccagacggccatgtttctgacggccactcatcgcaagatgaaggatcggatacatagatgtttcaaggagagcgtcaaagagggtcgcaccatagtaaaggccgagtactgtagacgtaaagcgggaggctcctttgaagcggtagcgttgcctcaaaactacaagtttgcaccgctactcgtactcatacagggctactcgtacatcaagtacagcgagacttccaagtgtgaggacgtggtacagtttgtgcgtaaagtgtcgcctacactcattgaggtggtaaactctagcggtcgtttggagcacttgcaacgcatcgcagtaaacgcctacaataccattgatgatttacgagtgtggctaacgtcgcagggtgctcgctaccagtacccgttgcgattctttaccaacacctactatagcgctcagggattgactctggacaagtgtgacatggaactggacttggacgacaccaccatgaatgcagtctacgtgggcctgactcgtatccgagagggattccgactgaagcgattacacaccaacgacttgtgcagtttagtgtacacgcacgtcaaaaacgacgagtactactacaaggtacccgaagtgcccaatctgtgtgaaaagtacaaaatcaccacggacgatttgaatcagagaatcatttcggtaaactctgtgctggcctatctgtacaagacggtaacgtttccagtggtgacgcctgaagcttttcgcgtatcaaagggccgatgcgtacgagtgctcagaactacgtacaaggagtatgtagactctttgcagacaaacacttcaccgttgctagattgctacaaacacatcaaggatagtgtcaactttaatggcctcaccagcaagagccgccgagagctgcacgatacgatacagtgtccgtgcacgttcaaagaggagcctcaggatcggttggatgaaaaggccaagactgatcccgacgaggtggtgtgctacgacgacgaaggtaacgagtgcattttacaatacgtaaagagtacagctcagaaggagcctttaaaggctggctccaagaggaaggttagtggtaaaggtgttgtcaataaaatggatttggagttggaactagagttggcgtcaacagtggagcctgaaccagagcaacactcggcatctacagcgcaacctgaagagtacggtactggtgccaatttcaagtcggcagagtttgtaatgttcgactcggcctctagttcagattcagattctcagccagagagcaaacgttgcaagcttgaggagttgcaacaagtgtctaccgagtgcgttgcatcaaacataccagtaggcgttgatagggtttgtgtaggaggaaccgattcagacctcacagattcagatgttgaagtgttggatagtgtggctttggattttgaaaaggagttttagatgtaggtgttgatgtaattgtaaatgtaaatgtagtttcaaagaatactcatagaccaagttgtatcaaatgtattgcatgttagtaaaaggtattgtatgttatgtagatgttgtttattaagtattgttttttattataatatttattaagtattgttttttattataatatttattaagtattgttttttattatttaaaaaatatcaaatcaagtacaataccaaagtatactactaacaccatctacacaagacacaaacctactctatgaaaactctactgcgcaaactctatgctccatttacaactcagttcaagttcaagatcacaacctccattacacatacacgagttcgttggcctgtaaacggtttacaatctgtgccaagtttaaactgttgtactctgtgtagacaacaaaggtttgtgccttttggtttctttcatacattgtacccgtgtgcgcaaaactatgcatttaaaggtaggcgccaagttgtgtgtttaagagtagctttataagagtcaggggattatatttgattttagggttcactgtatgcaacaaggataaggtttaaatcaaagagtccatcttgagaggtttcatcatttatttagagtttcaactcagtcttagatttaaagtcataatttgtactagttggtagattgtatgtttgtagattataatttgtagattgtgagttatacatacaagtggtaaaatgcaagtagtaatttaggttagtgttaagtatacatgtccaagtagagtgtctaaaaaaagaatacttaatgctagtatatacaatggtttaattaatattcattggtatatatcacagacttggtgtactacacttggtgtactatacttgtatactagatgctataatattacactgtacacattttaaaaatatagagtattttttaatatacctttatttatttttaatcattttatatttaataatacaacttatattctaaggataaattgaagcttatactctagggatacattgatgtttataatctatggatacatggaaacttatactctaggaggttacattgacttttattctaaagatatattgaactgtatattctaaggatacattgaaacttataccaacttatactctagggatacaagattgaatacaagactaaatacaagatcaactacaagatttaaattacatccaagtatgaatcaaaactccaaatcaaaaaccaactctaattctcatcactgctaaaatcatcattctcaatcaactctcgagactttatcctgctagggtcaatctttgacgatgcactagatttacgtgaaccattacttgtacgctttttgggagcactgttagaagggttggagctgttgttgttagtagggttagtggtgttagtactgttagcattgttagtggggttagtattgttagtagtattgttagttgtgtcagtattgttagtactcttggcactgttagtattggaatcggtattgttagtgggagtagggttagagttagagttaggattcgagttaaggttagagttagtgttagagttaaggttacctctatttgccgcattagcctccatacgtctctgttcgagccttctaattttaacgactcgactcatcggaaagtatccaccctcgatcatatcgtctctctttggtttggtgacagccggtgtagtgggcttgtttgccagaggcgtacttgccataggtgcacttgccataaccttgttggccatagccttgttggccagagaactctgtaccggtgcactctttaccggactcggtgacctactggcaacagactcgttgtcgctgctatcgcaacgttgcctcttactgggcacctctttggtggctctgtttgctttgcgtttcgtaccggcactgctagtgctgcgctttacatcgcactgctcaaacaagtcatcggcctgtcggtccagattcacatcggtatgattggcatagtccttgaaggggaaccatgtacaattgttaatcacaatggccatgcactgtctaaagttgctgggcttaccagaggccctcttttcctccatcttacacagagccatatacgatgccattatgtacttgatgtaaaactctttgatgactttgaaatagtcactgctgggcttaaagtagaatagaaactttacccacaagtttttcaactccccattaaactcgtccatcaagacatccatcacttggtccaccgatgtaatattgttcaaatccaacacattgcgacaaatgattacattcagtttaccatcggatggagtcttgatggtaccgtgctctggcatcggatacgactctttgtcgtggttcattgcatactgcagtgcgagcaccgaagctatattggctctggtgactcggcacgatctcttgttgaccatcgtggccagtacagacagtgtgatgagggtaatgtaattctccaaagatctagctatgcacgtcaaatcgccatcgtcaacttgcatcttgccaattgacgagattgcattctgcacatcggcattggtaatcttgttgggtagagaacccttcgagtctacacgattgccagtaaagatgcgctccatctttttgctaaacattttcaacttgggacacgtgtaagagtactcggccagcttcatttgtttgtatgcgcgcagaaactttatgcgcaactttagcttgccgctaagctccttgtccatagacttgtcctttagctgattttgaatactggcaatctgtttggataggctctgacgcacgtttgccgtttcacgcttaaactcggcagcggtgcaattcgtctcattgtgatactgtgcataggcaagttcgctaaccttgcaagcatacgtttcgtgcaactctatcggatgcttgtgcgtatcgatggcgttcaacttgtgcatgtgtttaaaacccggctctaccactttaaactcatcgtacaaggcctgcttgtcggcactgttactagtcaacggcactggcacacccagcggtgtactcggcagcttccttttcttttcgggtgcctcagacttgttctctggctcagagcatgcactagattcggaacttgtacgcttcttgccacgtttgggggctgcactctttttaggcttgcacgtgtgctttgacagattgcgtgcagtcttgtaggttttgttgcactgcttgcaagtcaaagcggcacgttcaatggccaagattgtagcctcgtcagtgcgtctgggtggattcattttgagtttgagttcatgcatacgatcagagactttggtgttggcgtgattgattagagtgggacgtttggtaggagcggttgaggattgcgtattaggttgtgtgttggactgcgtgttagattgagtattaatttgatcattagcttgagtatcaatttgatcattaacttgaacattggattgaacattggattgagtattgttgtttgattgagtattgtcgtttgattgagcgtttacatttactacagttgattgagaattggatgaagagttgttggatgaggaatcgttggaggtggactcgttggattgtgaagattgggagttttgattgttggattgagaagatgtttgattgttagatgtttgattgttagattgggagtttgatgcaagagttttagtaggtacaggagtaggtgtaggttttgcaacctttggtttaatggtcttttcagatgacgagttgttagctttagatttggatgcacttttagagttggagttgttgactttagagtttaccgagcctccttttacagagcctcctttagcactaccattcttaaccgagtttttagcactgccatttgcattcaacaaagagccccctttggtagaattccccttattggcatcggtcaactctaaattcaactgcaacgatttaagccgatcatcgagattcttgcctacagcaatagtggacttggtctttgatttcctactctgagatgcactagtaccactcttgacactggcattgtcatcctcatcaaaattgtacacatcaatattggacttggccgagcccaatgctaccgtttcaatgttggactctttaccggaaggagcaagattctccttgttaaaatcaccctctacaccaacattttcaacaatagtattggactcgtaatcgacatcatttacattagaaccatctacattagaaccatcaacattggactcgttagcattaacctcagtattggcattctccccattaccctcattgttaacctcatcgtcctcctcctcagcctcatcatccgatctattaccacctcggctactagccctactgctagatctactattggctctgctactagccctgctactaaccctgctactagatctactattggcctcgctagctctactacctttgcctccactacctctaccactattcacactacggttaaaactatttctagacaactcacgattgttgcactcgtcgtcttcatcgctggcatcctgagaatcgtcacgcctactctgcaccttgggttttcgcttgtggtgcggagtctgcggacgactgcgcctaaccggaacagagggctcctcctgactactctccgcctgagccttcttggtgatgttgtcaagcttgttgaaaacgtgctcgttcaagaacttaaagttttccatctcatcgtcaacctgacgcctacgcttggcctcggactcggagtcggtggcgtccaggatgccacgtttacgattgtgttcggttacacactttgcggccttgcgcaagagctgctccccgtccaccttgatgcccgaatagtccgagtcggcatcgctgtccgattccaaagaggctcgcttggcacgattgcgctgcctctcgatatcggtgttgtcggtgtcggcgagttcgacatccgtatcgacacccacctcggcaacctttcgagccatcagctcttggtaatcgaaaaacggcttatgcggctcggtaccgtaggggttctcggccgaggtacggggattcttcaaacgaggcaaatccatcttgatttgaggagtcccatactcgatgatattaaaggacatgtgagaggacgcggacgaagccatgcttatatcacagcaaagtgacctgctcaactgttaaactgcaaataaaattaaccgccataagttattgtatttatactaccgtctaatctagtacaataacgcacttttcgatgctagttttttcaaacaccatttttgatactctcctttatgagatcggtaacgttttgaatgagcacatcgtcgcccatatccgatgtttggaaggaccgaatcgttgcgagtgccatgattgtgatcgagccaaataccacaatcagaatctttgcgtacactttgcgcagagccatgcactcgggcgatttcggtgagcacagactactggcggactcgtctatcggaatcgttgtactattattgcggacgggctccatttcgatctgggtgactccccgtctccaccatcgcctcggtggactcggatcctctttgggtttgacatcaatcacagaggacgcatccgagccatcggtcagagtaccatcatcggactcgtaggatggatccgattcagagtccgagtcctttgcgaccggggcatctgcgggttttgatttcagagtttctgtactggtggtgctcattgtgctctcagtttcagtgtcggtatccaacgagtccactttcatgatttcaaccttaaagacgcccgatggagttttgtgagtgcgcatcatctattgcacaacaataccactgtaggaacatgaaatcattgaatgttaaagagccaactccaatagcgtattagaggtgtggttaaaaaaagaaaaacctaaaatttacattattcaagagtacatgaatgtcttacaaactacattagactacccggattgacttgctcaaagatggcatgtgtgaaaatcttttgcatagagtcaaaggtgtaggttgcatagtgcttgccgtttaggggctcaatcagattattataacactcgacgacaaactggtgaaacttttcaaattgctcaacatcgtttgctacatttttacgcatctcatggatgcatctaagattctgacggatcctgaccgcatcggacatgttgtaaaagagcatgtacggaaacaggttgacgttgtacttggcgttctcctcgttgaatgccgcctccaagtgtttgattttggccaaatcgttttcagaattgatgctcttcagttcgggatatttaatcttgagatcgttgtacatgccgctggccacctgattggcgccgtcaatgaacagcaccttggagcatcggtcgtagatgagactctcgatggcgatgccgatttcgtgtattatcaaatcctgcacattgcggtactcgacaaaggtgtgcgagtgcagcaaacacagagtgcccacaatgtttaggaacacgtcaaacattagactcagactgcgatggttgacaaactctggcttgaacgtgatggcacacacaatgtactgtcggatggcggtgagtttctgtgaaatgttgctgtactcatccgtcatgcgcaggctctgcacgttgccatacgtcaggtaggttacgagctgagagttggtcagtttgttcatgagtccggcgaccgtcttcattagcgattgtatttgcgcgtacgagttttgatcgatggcattgttgggatcgttgttggaattgaccattgcgttcaagtggttcataatgtcctctagggcagccttgcacgtcttggtcaccggtaggccaatgttgacgatgggcaccaggttggcaaaacactgagccagctccagggccatactcttgcgcatgattgaaaacgtttccgtgtacacatcggacacttgaaagttgttgtgtttgcgcagaggcagagtgttgaggtagacgacgtagggttctccattgtagagaaactccaagtcgccattgacctcgtacggtacattgtcaatcactacgcaattctgttgctggttcagttgaatgtttgcaaacatgattcccaaaaacaagagcactgcctacctatctagctgccagagtaccagtggtcgagtcacagtttacagtgggacaattactagaactagtatttgaaaagtacaagaatatgacaataaacgaatcacaaatggcctttaaaacagtcaacaaaactacaaagactcccgtattagaaccgaccgaaaccatcgtcatactataacaatgcacaagtttaataacaccaatagcctattgtgactatgtttacactacctgtacggtaatttcagtttttcaacgtgtctctatcttgcataggctattgtgtgtgtgccttgtatgcgataaagtttacgattgctattgtgcagtattgcaatgttgagggtcgtctaccgatgcatgatgcgacacaatctgattgatgagtttgcgcacaccgatttcaatcaatttattggtgattcaaacattgagctattgcaacttttgacttttagactgttggcttacgatcatcaagaggacgatttgtcaatcattctagactattacaaaaacattgagagcgacggtaagaagagaatcgaaagcaccgataccgacagcgagtacagtgtagactcggactcttcggaatcggacacaggagtaagaggcagcgtaccggtaaacgaaaacgagcaagagttgggttgcgggtgcaagaggcgttgagtgggagggaggaggctatatctttttagtgtaggagttttcaagagttttattttaatttactaatagtaggattactagtagtattagtagtagtattagtagtagaattagtagtagtaggattgggtactagtttggcatcaaaatgaacggtagcttcatctcggaactctatcgcaataccaaacccattaccaactctgaaatgacagagcccagtaccgttgcagaggccatcaaactgtacactaaaaaggccatgctcggaagctcaaagagtactgttgatgacaatgttaaaagtgccaacattgtcaagagcgctaaaatcaatggtagttttaaaagtaccgattctagtactctggaagctaccagtgctggcattgtccaatttacacacaatcaacacgtacaagatgcgggcactctacaacctctgcacaaaccgtgcatactcatggtagagtacccgtacacgattcgatccacgtacgcgtctctggatcacgatctggtgattgtggacagtgatttgcagcatttgcgcatcaacattctacacattgaacagccgctcataatcgacgacattgaggatcatctagtggtcgacgcggaccgcatctcttggtcgtacgatgaagagctactcgaggatgagactgtgcaaacgtttagatactatgctgccgtacagttggatcactaccacaatgaaatgcatgaattgcgacagattgccgacacgctgtaccagcactcgaaatcgctactgaccctcagacccacaacgattcgctccaagctcaatctgggcacgtacactcggtgtccaccgaatgcgtttccgtgctccatagtttgggccgaatcggtgaccgtctcgaatcccggctttaatctggtgctcatgtccaaggtgccggcaatcagcaattccaaaaacgatccctacaacagtctgatgagcgtcaacctgactggggtgcctatgcaagtggaaaagtttacagagcgctgcatcaatcactatacgtgcatgatgcacaacgccgacgacgatgccaatctggcagtgtttcagcactcggccggtgagagtagcaactttagcactgtcctggagggcatgtctcagactagacccgatgccactcgctacctgtccacgttcttttctacgctatcggacaagtgtttcgattgcgtctacgaaatgacaagatcctgtgtgcgtctaaatgcacgcaaatggatacacattgatcgaggagtgccctatacgattctgctcagacgcagtggtataccgcaccccagtgcacccagtgcacccagtgtgtccaatctggtcgagactgtacatctggtggacacggaacgatgcatcgattcctacattgcaacctttcatcgtatgaaattctacaagattgagattcacccattcggtttgtattccatggatgaaatgggcaacattatgtatgtgggtgtagtggataaagtgtttaccctatctggcttataaactagtgtatagttgtagaaatccaattactttttggtatctagtatacaggctgacagagcccaccaaccatcatgggtatcctaaagtttaacaacgttttcaagcagtacattgtcgactcgtacgacacacccgatcccagcctagagtatactgtacatgtggatggcaatttgaccctcttcaagggtgtcatcaacggatgcgtagatgcacacactatagccaacaatgcgttggatctgctcaaagcaatgatgtaccgattgagtgtcaagatttcagaaattgtaatctatttcgatggcttgcctcctacgcgcaaacatgacacttcaaagaagcgtgccgtaaatttaaagtttaacgcacaggcagcgcttcagtactacaaggccatgctcgaggaagagtcttggttccgagtggtacagttggaggtgggcgaaagcgaaatgcaaatgatactggatcgcgatcccaccaagcccaccatactcgtgaccaacgacagtgacgtttaccacattgcatacggtcggtacgacgatgaggctcccctgtacctgttgctcaatggcggtgaacgattcgtgaatctgcaaaagtttaacgtgtgcggtatgcctaggaatgtgttttcggcaatcgttataatgatgggtaccgattacactcaaccgttgctaacaccgtccatggtttcggccatttgtcagtgctacatgatgaggcatcaggatgccactctgttgaacgcctttgatagcataaccaacgattccctgtcaaaggccaaacactggcgtaccgtactgtacgaagtgtgcaaggtaatctttcatgccaagaatcagcactcgatacgcattcactttggctccaaggtgatggacaagcgcaccgccaacaaggacaatcccaagttgacttgggcagaaaactgcaccgtagaacgttgggtggaatcgttggcctggtgttcgcgctactacgaacacggcaaccgtgtggatcgatactcgaataatgaacagtgctttgagtttatagagcccacatcacagtggcgtctaatgaagggggccaagagtttcggaatgggtgatttgacgtcttggcgtgaaggctgcgagatgcaagttgacgaggtgcagagaggtaaacagttgcaaaaattgcaaatgtctgaggttagaggggactcgaagagagattataaaggatgctcaaagggggattctatagtagattctaaagcagagtccagagtagattctattggatgtgatagagtagattcgaatacatcaacaggtaacgagtataaagagtctaaagaacacaaaaattccaacaaagacgagtcaaaacacattccatcaaaagagtcgaatcactcggaaattaaagaatcctctgaggataaatccgagtgcacttctgaggccaactctgagtccaactctgaggataaagccacttcaaaggatgagagcaaagagccgtccaatgactctaatgaagcatctaaatcaaactcgaaagaaacatccaagtcaaccctagactcggaatctgaatctgtcacatcgaccagtacagattacacgatcaaatctagcaccatagaatcgtactcggaagagttttcatttgaccgttccgagtctgaatctgatccgtccatcagtctgttggaacgagtcagggccagggatcgcgcactcgtcaaacctaaacgcatacgaaactttgtactgtttcaattcaaagactcgttgatcagaccagacaaggcaatggtacaacctagcctgtttggattcaagcccatacaacaagatgatccgtctgtggaggactcggatccagccctcgaagagcccatagactttgagtccatcgagaatgaagtgtcaccatcaaagattgccaagacgagcaacgatgagtttgaaccggtcagtagcagcagtggcagtagtcttcagttggactcggatgatagcatgtctatattgttgtaggatgtttgctgttgatgttagtggttaggtttatgcttagtcttgtgtttagccttgtgtttagattttacatttacgattatttagagttctatatgtttgttttgtattcatcagagtttatagagtagagtttatagagtagagttatatatatgtataaatataaatgttgaataaagagtgtaatgattctatttttttcatcaaaagattcttcttgttttttaatcaaacatctactcttgttttttaatcaaacatctactcttgtttttttaacccaacatctactcttgtttttttaacccaacatccactcttgttctttaaaccccttgatagtactggtactcttccgagtttaaaacatagagtactggttaatgtctccatttgtttgaaatcctatttactctagagtgaatcgtttatggctacactttgatggaatcgggtcaggttaatgaaatggactcgtaaactctttgattggctctatattgaaaatcaatattgaaaatcaatgagtctaggggatttggtgattcagtgtatggttgagtgcagtgcatggttgatgcatctcaaattgaaatggtataatgttgtgagctctgagaacaactaatcaagagcacacaccggaaattgtcatttaattaaattgatcaacattaatcattcaattaaaatgtaattaattacgcaactatatgacacatttattgataatacggtattggtggtataaatggggcaacattagtagaacaattgcacaagtgatccagctctcttagcttcatcttgtctgctctgaatccaaatcattaaaatgtctgccccagtcctcaagtaccgtaaactgagcaagaacgccaagatgccgatccactctaccgaagagtctgccggattcgatctgtgcagcgctcacgaggtcgtcattcctaaacggtcgagggtgctcgtcaacaccgacctcggcgtactgatcccggaaggttgctacggtaggattgctccgcgatccaaactggcagccaagtacggaatcgacgtcggagccggtgtcgtggaccgcgactatactggaaacattggagtggtgctctttaaccattccgatgacgactttgtagtgtcaaagggtgatcgcatcgcacaactgatttgtgagcgtatagagattccgacccttgaagaggacgacaccatcagtgaacgtgtaactgaacgcggcactcgtggtgttcaaatgtgcattggcgatcccatagatgttgccattccaccggctcacattctaaacattatgaacgatgaaatggaaggtttagagtcacatcaaaagtggatcaaagccatcgacactgtaatggaggcggtgaccgatgagaatctggccgaagagtttgtggccaacttgcacgactctatattcacagagtgtgacgatccggtgagctatgaagacatgctgaccaaattgtatgcagtgttttcaagcaacgagtccaagtatcccggtgacgttgcctacattgatgctctgcacgagaaaatgtacccgacaaaggaggctgtcgccgagcgtacagatggccagttttcatcatccaaccacttgtttgtcaaccaaaagatttgcaacattctaacgtacctcatgagctctaccgagtacgatcacgtcaaggaggtggatgagagcaagctactcaatgcagtgtttgacaacttgcaggccaactttgaagcacaaaagaagcggccctttcttgaccgtctgatggacgcagtacgcctagtcaaggtgggaccgttcaacactctgttcaaggaggtgtctgaagctatggatgcaaaagctgagaaggagtgttgagagttcagaggtggtggtgtagagtgatggtgtttagaattaagagtattgtaaaccagtgtctaaattgtaggattaagttgtagtattaagttgaatatgtatcattgttgaataaataaaggtttctttttttggtatttaaattgtttgattttttagagacttgtactatgcaagtaggtttggttgggtaaagagatggttcaagttcacttgtaatattttaggtgcagagagatggttcaagtccacttggtatgctaaagttacaagcaccaaaacacagagttgtccaattcacaagtaatggtatgctaaagttacaagcaccaaaacacagagttgtaaatgctttaatttttttcatcaaatcatttacatgttgtttaaaaaactaaaactagtaaccccttgtaagatggtcctcagaggtatcaagtctcgacacacgagtaccattcagtcacgagtaccattcagtcaacccgagcaccattcagtcaacagtgcatttcaaacagtctcagtgtagtgtctttgactttgacaatgtgcattcctaaacattgggcctttgtttgaacctttgtgttttgcacatgcattgtatggaaattgacatttgttgctaaagactagtagcaggcgtttagagtagttggaggatgctagaggcaggtgcttaaagccatctctctgtatgcatgtgtgtgtacattttaaaagtattgtcttttaaagacatgtgtgtatgtagaaatgtgtagagttgaatggatgcattctctttgcatttaaaggtatagtgtctaaaaaactagaatcatttattgactaaaaaacaaaactttatttaataaacttttacaaaacacggtacactacaaggtactctacaaaagtaaaaggtacaaggtactctacaaggtacaatacaaaagtctataacagcatcttataatctacaacattattcaactttggtatacaaactgagcattagagtattttgtaaaacattttaattaagagtattttacattacattcagtctacattaaaatcttagtctattcttataatcttaaaatcttggtctactttagtctttatcatcctcactcgcccgctggtacaacatccaccaccacttgaccgttggagagtctcttgtacgacgctcgttccggctgagttgcattgtctggaatcacagtgtatctaaacgtgtcgacagtgtcaatcatgcgcagcaacgagtagtcaaacgctccatcggccatggctgcgttcattgaagtgttgtagtctgaggccgtcaagtgtccgtacatgtgttgcatctggcaaatgtgcggatggtctctaggacagttggcccagaacacgctagagtcgtacgggtcggcgttctttaccgacattttgtattcatcaaactcgtagaagcccctgtctttgaagaagtacactttaccgttcagccaggacatggcggcatcgaccggtgtctgtaggttgcggaaatagttggcaatgaggtaggtctttgttgcaatcctgtccttcttttcatcaaacaaccagtatttgtcaccgctcagtatgaacgtcttgttgtgccatctaaaggcagtgtcaatctttgagccttcgatgcccatgtcggaaagcttctttggatacccttgcgcaacatcattgcccgaaaagacgtacattagatcattgatgaacatggccactttaccatctttgcgaatgtagatggcgtctagcttttcaaagtctggcaaatggtacactttgttgattggatagactgatatagtcttgggattaaacgagcccatacgccaaacaaacggtcccttgaacacgtacacttcaccaaacatgttggccacactatcatacttgggcaaatcacaaatgtagggattgccaagtttggatttgtacgtttccgtcttgggtcgctgtggcggtggtggcggtggtgttgttactggtgtcggtggtggtcttgtcactggtgtcggttctgttaccggtgctgcagcagcctctttgtacgattccttttctcgtttgtcactgggattggtgtgagtaccatttctgttgccgtacaaggctttgattgccgcaatgtcatcctctttgagttcacgcttgacaccaccatagtatggatacattacggcatcgtgaacatcactgtgacccacacccaatgcatgaccgagttcgtgcaacgctatcgattggaagtcggccgactcctcgggtttgcgctcctcagcgttattcgaaaagacccatggctcttcggcgtcaatgtgaatctgaccacctctgccgggtcccggatagaaggcgtgtgccaagaaccatccgttgccatcgaatcgtgtaccgtctccgtgatcgccatgataaaagcccagtgtaatggtagacttggaaccgggggcgacctctacaaactccaaggcgggagcctctcgcttccaccgtttgagcattctatcaacatcggtacggataacgtttatattttcaatattcgaagagttggccaaaacactccaagttatcggattcttccatgtgtcgtggagtgtgtatcgttttgcgcgcttgggtgaaatgtctggcatcgcacaccgcttagtgttcatctttgtcttggtgtgcggatccatgtcaccggtgattggtatgtttgcatacgattggaatcgttctagtgcaccgactaccggttgcatggcaggctcctctagtgacagtttaccatcggtcaacctaagatgcgcgcctaccataaagtcttgcagatagcccaagaatttgagtttctccaattcctcgggcgtaatgaatttggactcgtctttggtgttgtatcgtttgcgaatactctcaggttgctcattgtcagaatcggccacattgaacgggttcattggattgaatctagacatggcatccatctcggaatcttcattcgactcgggtatttcatcaaccctatcaaacggattcatttgctgagcctgttgttgttgttgcggttgttggtattcgtcaatgtactcatcgggaatctgaaactgatcttgatctaccgcattgaatggattctgtctattgtatgcgtgaatttcagcaagatcagattcatgatcggcataggttggattggatgtaggagcaagtctgggtaatgtaggtaagtgtttacgaaccggtctaactgtagcatgaatgcgcttgttgacgttaactcttgtattgaacgagttgtcatcgtatagattgtcatagcgttcattttctagacgcatggttggtgcatgtttaggattaactctaaagtcagagaggtagctaaaatcatagtttctacgatcgggtagtgtattgtatttatcaaatgcacccgcaccataccaaaagagtgccagtgctaaaatgttggcacccttcatacttgtaaatgtacctatagagctaaagatgcaaatgagtaaagacacgcaagagagagaggaaaagagactaacaaaggacgctcgcctacataatcaaaaaaatagacgattattggtgtaaatattctttattaagacttgtaatacatgttgggacaaagcacacggttaaatgtatagattacaatttttagagtacacttgcaaatcacacaaattccctatcctcgctacaaattttggcatacacatctctagcgtccctagcaaacctggcatactcttgggcagtgtccttggcgtactcttgcgagctatagctcttgacaaagccttcaatgatgcgaatcgtacccttgatggattccgagtttgcatccaccaccaacactggtgccgggatcggtttcttgccatgaatgagccagtcttcgtgcaactcgtgcaacttctccaagtagggcaactctatgtgggactcttccatgcgacctcggcgaatcgtgcgctccattgcaaccgagggatcggtgcgcatgtacacaatgagatcgatccgcacactgtctatcaacacttcacacagactcttgagcacgtccgcattcaagagtgccatcgagtctgcatcggtgggatcactcttgtccatgatcgatgatgcaacggcctctataaagcaattttgaacactgagcaaggagcgctccataatcttgaaaggagtccgcaccggtcgagtgtgagcctcaaacattgtagtgcatatatacgtttgaaaggccgcaaaccatttgactggatcgagtcccatgccgtgcaacaggttataccctttaaagtttgtccattgatgcaacggctcctctatggcggtgaaagagtccaagtttttaaagtgattcaagagggccgatttgccacaagcaatattgccctcgatgaggatgttgaaggatttgctcacaccactgcgagcaaggtccgtagtgcagttggagggcacggtaaaaagtgaacgaacaccggccatgatttattgcaagactgctaaagtcgacgtctagtttaccacaataccgtatttacactatggcgtgcaaacttgcgcacaactaaagtcagaatgcgaaaagtgaacaaatccgctcaatattaacactaatacgctattggtgttatatcggtgtcgactctcttagaaacgagcaaaatgtttcagctttgaaaaggttgaaaaggcgttttctatgcaaatcgttctagttttttagaccgagtctctcaaggttatgcatggactcgggactcttttgtgcaagttttgtttgaaattgtgcattttagctctttgatgatagaggtggagtttgtcttttgattttgagttttttagactcgttgtttggaatcggttcgtagaggtggaggtagagtttggctattgagtttgagttttttagactcgttgtttggaatcgttagtgatagagtttgtctttggagtttgagttttttagactcgttgtttagactcggtatttggactcggtagggtgactctttgatggtagagtttgacttgataattctagttttttagactcgttgtttggactcggcagtgtgactctttgatgatggtgtttgtctttagagtttgagttttttagactcgttagagtgaatcgttaatgtcagagtttgactttatgattctagttttttagactcgttacttggaggactctgatgctagagtttgactttataattctagttttttagactcggtaaatggaatcgttagggtgcccctttgacttggtagttttagttttttagactcgttaaatggaatcgttgttgtccgagtttgtctttcatgttctagttttttagactcgttaaagggaatcgttgttgtccgagtttgtctttcatgttctagttttttagactcgtcaaaggggactcgtcaagttgctctcagagttgtgtttcaagttttaattttttagactcgtcaaatagactcgttaaaggggactcgttaaaggggactcgtcaagtagactcgttgctctaaacaataccagtaatgaatctctacgaaaccgatcccgagctgtatgcgctcgtagagcaagaggccgatcggcaacgggcaggcttagagttgatcgcatcggaaaactttaccactctaccggtgcgagaatgcatgagttcgtgtctcatcaacaagtactcggagggtaggcccggaaagcgatactatggcggtaacgagtttatcgatcgcatcgaactgctagcacagcagcgatgtctcagagcgttcaatttgaacgagtccgaatggggagtgtgtgtacaaccgtactcgggctcgatggccaactttgccgtgtacactggaatcgttaaaccgcacggtagaatcatgggactcgatctgcccgacggaggccacctgacgcacggattccgcaacgtgtccgctacatcgctctttttcgaaagcatgccgtacaaggtggatcctcagactggactcgtcgactatgccaaacttgccgagagtgccaatctattcaaacctaggctaatcatagccggtaccagttgctatcctcggcgcttggactatagacgattccgagagattgccgatgcagccggctccttgctgatggccgatattgcacacattgcgggcttgattgcgggcaaagtcattcctggcccctttgagtattgtgacattgtaaccactacaacgcacaagactctcagaggccctagagccggagtaatcttttaccgcaaatcactagagcaggaaattgaacgagccgtgtttcctggactgcaaggtggaccgcacaatcacacgattgcagcgatcgccaccgcaatgcaccaggccaccactctagagtttgcactctaccaaagacgagtggtgcgaaatgcacagttgttggcagagggactcgtttcacgaggctacaccgtcaccactggcggtaccgatgtacatctgattctagtggatttgcgcagtgtgggactcgcaggagcaccggcagagcgcatcctcgaactgtgcagaatcgcttgcaacaaaaacacagtgcccggagacaagagcgctctcagaccaagcggcatcagactcggtactcctgcggtgacgacccgtggtgtcaaagagtgtgacattgaacgcatcgtagactacattgattgtgctctgaaattggctcgagagattgtacgagtgtcgggaggagtgctcgatttggactcgttcaacaagacgatagaatgtagtgcagagtttaagagtcaaattgaaagcatccgaaacgatgttgaatcctttagtaggagccttgactctaacgttgacttgtgttagatgtgtgatttgctataatgttgaatgtaggagtttttaatattacaacagattacaacttaatgtttgaataatgttgtacattgctataatgttaactttaggagttttgattttacttgtacatgtttgaatgatgttgtgcgttgctataatgttaactgtaggagttttgatactacttgcaacttgctatacttttaaatgtaggagtgtaaaaaatatatgtataaataaatgtttgattaaaaaacaaaagttttattttttaaacatatgaatatttattgtatgaaaaaatacagagtatactatgctaaaacttgtgttgaagcttgtactaaaacttgtattgaagcttgtattgaaacttgtgctaaaactcgtctaaaaaactaaactctaaaaaactaaactctaaactatactaaattacaattctatataattttatacaattctatacaaccaaatccatacagtcaagtagactctatacatataattctacatttaaaactagtacatctttctataccacaaccaccaccaataccaacaccaataccaaaaccaacaccgctaacactaccaccaccatcaacactaacaacatctctctaaaaatcctcactaatcttaaacacattatcctccaaattgacaccgacaccgtagcgtttgtactcgctgaccttcttctcgaaaaagttggtcttgccctctagtgatatgctggtcatgaaatcaaagggattcttggcgttgtaaatcttgcggccaatcaactcgtacagtagacgatctgccacaaactctatgtactcgcacattagcttacagttcataccaatcatgctgaccggtagggattcggttagaaactcttgttctatcctcacggcatcggttacaatgttgatgaccttttcatcgctggatctgcactcgggacgcagatagttgcgaaacagtagaatggcaaagtcacagtgtaggccctcgtctcgagatataaactcgttactgtgcgtcagtccgggcatgagtccgcgcttcttgagccaaaagatggccgcaaaactacccgaaaagaagatgccctctacggcggcgaatgccaccagtctgtcggcgtacgaagacttgtcgtcatcgatccaccgaatcacccattgagcctttttacgtatagacggcaccgtgtcgattgcgttaaagagcatgtgtttacgttgcggatcgcgaatgtacatgtcaatcagggtagagtacatttccgagtgcacattctcaatcatgatttggaatccgtaaaagcacgacacctctggaatggtcaactcttgagagaatcgcgtcaacagattgtcgttgacgattccatcggagccggcaaagaaggccaaaatgtgcgatataaactctcgctcagtttcagtcaaacgagtctcccaatcgtacaggtccttggacagatcgacctcttcgaccgtccaaaaggaggcctgagcctttttgtacatttcccaaatgtcatgatacctgatgggaaacagggtaaatctactgctgggctcttcgaggttaaactcggaaatgcacgaagtctgaccgtccatgattagtattagcggtttctcccaaatctactattgtgtgtgatggaatagagacaatagcctattgttgttgtattcaaagtcaagtacatagtttaagctagtttatattacaacaagagtagcatatcataccaacgactctttggtggtttctttgatagaccagtgtagcaagcgatcgcaaccaccacaatcaccacaatcacatagaccaccgtgatgagtgtagtgctcacaccggtcaagagtacattggacgcatagtacgtgtcctttttgaggagtcgttcaaacgtctctagactgttgaccgatgccggtgccgagagtagagccccagtctcggcatcgatgaccaccatccgatccaggtccacgttttcgattcgatcaaagttttgctgtttccggaacgagtccacgagtcgagcccgccacaggtgcatccaaaacactcgacaatagactggattgcgcagtacgaaacagggacgctgatcgatcaactcttcggtccacgcattgtcgggcaattgtagtttttgtaaatctttaaaatccaagtaaatcatgtcgatcactgtcagagtgcctatcgggcattgtgcaaatgtgcacgtggtctagtgcagagtttatgcaatgttttattaaatgcgcacaagtgtgtataaattggccaacaccatttgtcaccggtacagtctttattgtgttctcaaagtagacggttctctctgactatacctatcctgcatttaaaatcatctttctaaaatggagattgtatccaccaactctaagcccatctggagtactgcgcaaatctactctatagagcccgttgacgagtgcaatacgctgattgtagacgtcaaggatctgtatcgattgttcaagctgaagcgtaccgatcaaaagaaggtgcgaccagttggattgcaagactgtaaaatgtgcatcgaacacggagtgactctgaccaaggatgcactagactcgttgaccgaacctctggaggacgaggatccagacaaggcggacgccgagtgctgtgtggcatcgcacgagtacagcaatgcgtttggtgtacgagtactgggcaagtgcttcatctttcccctgcccaagatgtactcgatcaaaaactttagctttttccgatccatcatcgagttgagttttcaaatggagcacgcctacgagacggacactcccatgccggacaagatcaagctcgtcaagccgtccgaggagaatgagttttcgtgcgacgatgtcaagactttgattcacaagtacattgataggactctgaaaaagtttctgcaaaacgatttcaagtgcagcaactttagcattctacaatcgggcaaacggtcctatgtacgatcctacctgctgggccacagacacaacggagcccgtatgacgatggtggtggacaatgagctgggacccaattcaatttcgattccgcgagacatttacgacaacctggatctggccaccaatttggtgattatcaaccgtgacccgagcatcaacgatacgtgcatctatgtgtgtgaaatgtttcatcacgacaccgatccctgtattcacttgaatccgtttgtactggacggtctgcacgctgatcaggacggagacgacatctcaatcaattacctcaagtatgaaaactctatgaatcgcaacctaatgaagatggccatcaccgagatgcgcagcatgtcctggaactatggctaccggcacaatctgttttacaagccacgctatgcgctgggtcaacagtttaggcacttgctctacacgcacgacaagtggttcaaccagcactccaagttttaccgaatcctcaccaaggtgcaccgtggcaatctactggcaaagattgacactctgatgcacttgggctgtagcatcatgaggaatgaggtgcacgatttcatagaaatggtgttggcattcaactgtaagaatgtcgacaattgcctgaggggctcggactatctaaagtgtgacgatgagattctcgaagtggtgcactccaagtcaaagggcaccgcccggcacattgaactgtacaagtacaatctgacgaggacgtctgacgagcaggctctcaagtcggcctttgacgacaagattgattccagcaaagtgttggaacgcgagggtcagactcagttttcgctgttgcacgctctgtcgccggccacactgatgatgggcgatctctatatgggtgacaagattgcagtgaaaaactttaccgaaacctctctgatggacgtgtacaagtacaatccagattcggtgcgattcattctcagattgatactgatcaattcggaagagtttgtctccaagtggtgcaactatgatcggtcagagtatgactttacctttgacggtgacgatagcagtctgtttaccaagaagcgtcagatggccacctttagacgcaccctcaagtgcatcaatagcatgggcaagtctgaatcgacactggtgactgacattacgggaccaccgaatcgagtcgattccgaggctggagacaatctaaacattgcacgattcgtcaccgtgtggaagctgattacgcgcaaggtttgtattgagcgtgaagcgaaccgtttgcggctaaagagggccgccgagtacaacatcaaaaaggaggcggtcaaacgcaagctggacgatgagtttgccgcagacagtaccacttgcagtagcagtgtgcacagcagcctctacaagaagctagacccggtagagttggaaaaggaaatgatcaaggctgagattgcactctacgatcagttttacgaggactggatcaatctaaagaatttgaccaagaaccaattgtatctgttgtacacttcaaagaatcccatgatggagggtatcgacaagacacccattggcctacactatagcatcatgattcaatcgcaaaagattcaaactgcactgaacgtgaagcggctcaaggatgtcaaagagtcgcaaatgttcaacaagggcactatgaatccggttactccgtccatttgcatcaagtggctgtacgcaccaaagacgttcaactggtaccgagtgtcgttggacagtgtggccaatgtggatgcagtgttggccgcagtcaaggattgcgtaggctatgccattctgtacaagaatatcgtagagttttactttaaggtgggtggaccaaagattgtactatcgcagctggaacagttgaacggatgtcctcatgttacgcgcatagtgtttgtggccaactgtagagtcatgctggaactgtatcaaaagaagcaaatctcggcagtagagatgactgacaatctgaccaactttttgtattgctactataccaattcgctgtgcgtggatcacagtaaaccagagtacatactaatgtacaactttgtggccgtcatgtttctactgaatcgcaatctcaacaatcccaccaactctaccatcaagttgccgttgcacgctgtgagcggagagtttccacaacgagtgctggccaacatgatcaaacccaaacgtgcgataccacagcgcggctccataccggccagcaatagcaacatgggtggcaagagcagcactagcaacattttcccaatcaccaccaatcgtgaacggagaatgtttaaagagttgtgcgatgtgtttggcggcaccagtaccgagtttgtggtggacgtgtacaatgccaagtgtcccatgtccaatgacttttgccactatacagagaccaaagagtttatcggcagatgtagtggcccgcttacaaaactcaatatggacaatgaaaaggctatgaaagagttgatgaacaatctaatggatgagggtgaggtgtttgaagactttaagaatgccaaagtggaggccaacgattcggatgtgtccttttcggattgtaatgtaaagtcgatagatgaggatgaagatgttgagggtgtagaggtgaaggtaaattatgaggagtgtgttgaggttaaagttaaggatgaagttaaagaggaggttgagtatgatgttaaagaagagtgtaatgaggaggattgtaattttgtagagaatcaagaaaacccagatattgatgaaaatcaagagaatttagagaatccagatattgatgaaaatcaagagaatcctgaacctacagaaatggacgaggttgatgaaactgaggaagagggtatagaaaaggacttgtgtttggatgaaggtggtttggatgaaggtggtttggatgaagatgtcttggatgaagctatgcaacttgatgtagatgctacagaggacgatgaaggtagtgtagcaaagaggtctaggttggagtgagtcttggtgtattttgtctagtgtaacttgtaggttaattgtacctttgtaggatacttgcatctttgtaggctacttgtacctttgcagctctataataatacaactataatattaaatactaaatactaaataaaaatattgttaaataatatagaatactaaataaaactaatgtttaataatattgaatattaaataaaaataaatataaaaactaaacccactggtattcttattttttagagacccaatccggatcctttacttatcccccagtaccttgtcctaatacaaactaaagtacaacctataaagtacaaactataaagtacaaataaagtacaaactatcaactaatccaaactctacaacactctgccacaatgagttttacatccatctttagacgtgctctaaagccagtagacgagataccggccagtaccgtgagcacgctccgaaacgccaagaccggtatacgttcggttgacgatgtgtttggcacactcaactatagcctggtcgatcggcaactggccgtgaacggtgtaaagctacacactgtggaatcgctattgcgccgaggagagctggcgtccatgtttagcaagctgaacaaacccaccgccataacggtggccgatgagctaaagtttcgcaagctcatcgacaccccagacattagaatacgcaacatggaagagacggtaaagagtgctcgaatcatacatcccgacttggacattgtggtgactagcgcctcagacttggaacgattaccgaaagcctccaggaccaagctaaagggcatcgttgacaatctgtggagcacggtcaaagtgggtggtgtggcggtcggtatatttgcggccatatccatcggagtgccctactatgaaaagctggtagaggctacggttgcacgcaacggcttctacttggtggtgctcaagggaggcaagactacatcgttcaaggtgcccactagatcttgcctcagcacctccgtgacgggagtgaagcacatttccgcagtcaagtacgatcatttggacaatccagtcttgtacctattgcacaccatcaacgatcccagtgcagagatggaacggcagagtttgaccagtgtactgggcggtgtgacacccaccatggaaacgttcgagaccatcgtacagaacgacactctgtttgccaaagtgtcggaacactactaccattcgtcagagggtcatcctttgaagaatccctgcgatctggtgcagactgcggacaaggcaaaggtgccgtgcaccggcttcgatcccaatgccgatgagaaatcgtacgcctacgtcaatacgtatactctgcccgataatatgactttcaagtgtgtcaccaattctacactgctagagacgatcgttgatgcggcaggtgatgcggcccactacattctgggctctacgttcatgaccaaactgggctcgtacctgaaatacattctactggcagtggttgcggtggtgctagtcatcattggtcgattcgtgtacgtcaaattcaatctgggagatttgctcaaaggacggggacgaggacgaggaggtagtgctagtggtgttggaggtagtgctagtggtgttggtagtggtgatactcggcctttgttggaggatactgacagtgtggatgttgatgatgatgtagatgtagaatatgtagattaataaaaaaatacaacttgatacaattgtacaactttaattaattaattatttaataaaaaaatgtaatgtaacatactaatatatataaaatatactaatatatataaaatttaataaatgtattaagaaatgtaaacaatgcttttatttttacaataggtttgaattggtttacaaattggtttccaaattggctcacaacaaatctttaagcttcatcacacgatcccttccaaatccaaactagaaacatgtcagagatacctctagtctctatggtagcaatcttggttgctgttgctgttagtgttggtgttggtgttgcggctgttgctgttgtcgttgttttagaattgcagtaaccaatgccattattggatagcgacacttcaggtttaatgtcggcatggtaatctacaatgtgaactacaaagcgtggtatattttttagtaccacaaatataatgtattttagagcgtaaaattccaagtagacgtgctcgagtaccggataaaagatgggatcgtttgtatggattcgtctgttttgatagtctaccacaaaccatcctattgcattcaggtcagagtcgggaggcaatagtgcaggatctacgggatcgtttgttgtgcgttcattgaggaaatctatacagaaccattcgtcgtcacctctgtccgtttcgaatgcatcgatggtgctctcgacggaacactctgccgctatggcatcgcacacatcgtacacgtactgagcgctcggtttgaacgtgtagcattcgtgaaatttatgtgtagacaacacgaacggtggtgtgctggcatcacgttcaatgccttgatcaacgttattgttgtacgcttcattatcggactcttcattgttgctttcattaaacaccgtaccgttatcatttaggttgcacaatggtaaccagtaaccttcaaacattgtatgctagactttgtagtaagatcaagttgttggaaattgtgcattcactactactgctactagtgctaatactaaaaaataactactcgtacacgtgttgtttaaaatgttgcatttactcgatacaagaacagtattgtagtgtagttggaaaaatgtacactttttacattagtataaaacactttttacattagtataaaactaaactctattcttccagacattgctgcgtctgtagccactgccaaacggtatcaccggaggacgctcgatactcttcatgttgggcactgacgatgacttgtacattttcgatagtttgactcggaccaatttgtcgtgcatcgctagactcatgcattcttggcaaatctcaccgagttgcaccacgtgcagtgtgtcgtggataaacatgcgactttcaaaatcgacatgattacacttgccgccgtcttgacgtgcaatcaacaacaggtagcccaattgtgccagcttgaatcggtccactagtccatagtcggaatcttccactttggtgatgcagttgagtttggtcaatagatattcgaggtccatgtttgctcagacagttgctatttatccttagcagttactatctatgtttactatttattcaaaaaactagattaacaagtacaagtatatagacatttaaatacaaggaaatgattagttaatgaccgtgtggcaaacaatgaataggtttacactctcactttacatacccatctacctatagatttattaatacaagtatacgcttacaaccatattcttataaccatattcttacaaccatattcttataaccatattcttacaaccatattcttacaacaagatgcactttaggaaaaagttggtcttcaagcctggcttttcgatgctcttgaacagtaccaatagtacagtgtttacaatgctcctgtccatgctgtgtgacaatctaaccatttcacgcacatgtgtcggtttgcgtttggctttggtgagcttcaaaaaggccaccaacgagtccttgtaggcacgcacctcgttcaggttcacgtaatagttgcagtcttcgtcgcccatcaagtgagcaatcacctgatcgatgtattgcatgtcaaagatttgcagtagcttactattgatcgtggtcaatcggcaagagtccacttcgtgcataaattctaaaaactctttaaggctcgtatacgatgccaggtcgctgagcatgtgcggtatgttgtagtccatcgagtacttgggaaacagtttaaacagcacggccagttcaaacgctttacgattcgttatactgccactgattctctgaaccgtatcgaaccaccgtttcaggtcgtctgtgattagaccacgtctaacgtttacgcactgtttgcgcctgaggtaggctctcacctcgaacggtgtcacttcgtgatgtatgaaatcgtgcgtagacggtcccgcttcgttggcctcaaagacactaatcagccgatccagggtaaagtctttgttggtcatcaacaagacgaccgtatccagcgatatgtaatcgcatgtttcaatataagagtccagggtgctctttatgatcggatccatgttgcacaaatactataaaacacgtaaattgtacaagtctaatacgatatttcatttatcaggcaactgaatattgttgaacaaacgcgtgttacattcgcatttatacaaactcgactgagacgacttttgcagtttactactgtccttgctgctgctataacatgatacagatggcttttatagtatacgagtgccattattttgcattattgaaattctgggatgggtgataaaagaaacgacaaaactcctacttgctaatttatttgctaagttatgggctacttacatggtacttgagctaccttacacgctatttacatgctgttttatctacctattttacttgctagtttatgatgcattacatcaatttattgtgttgttgtattaccgcctttacattttacaacaaaagtgtgtgccactacatgctatgcttaaattaaaacaaaacgatgcgcttaactctacatgtgcaattgacctctcatttgaatgtttttgtgttttatgcttttacaatttttatgtgcattttcaaggattttgtattgtttttggggtttcttacattttatgctttttattggattttgtattttttagcaactatactatgtgtaaatcaaactatactatgtgcaaatctataaagtgtaaattttaacctaacccaaacttaaactaaacacccgtctctctacctactacctacctacttacctccctacctctaagcctccttaaacctaaacactaactttagaatgcttataccaacatttattatcacagtcaagtgtttactgcttagctacactttttacaaggcttaaactagtacttgttatgcttgattattatttctgatggttcagattattggtgcatctgattgttgcaatttattctcttattgctgataagtatagatgtattctgggctctcaatactcggatgcgtgggaattacctactactaatactactattagtacaattaataccaatgaaactactactagtacaactaatgccaatgcaactactgccgaataaataccgttgggatagattggggaactacttaccaatactactaatgatactaatgctactaatactaccaatactactactatgctaaatacacaattctatacaattaactaatactccttacaatataaataaatagcaatccaaggttgacctaatacgcagattcaaaaactatgctacattttacaaattgtacaaagctacaaattacaagttgcatactaaatggaagcactatataaatcgacactacttcttatgctggtgcttacactattccacttgttttacctgtaaaacttacacacgctaaatcttaaactaaaccttaaaatgaacgaaaccttaaacaaactaaacatttaataaacacactataccttaaaataaacacgctgtaccttaaagtgaaccaaaactaaacctttaaacttatataaacttgtataaacatagataaccctcgacccatacgacaaagacaccccacccgttaaacctacccactgccaatactattgaaaaaatcaacattaacctaccgtgttgttgctctactttacaaattacttaattggaacttactaaattggaaattacttaatttaaacttacttaattggaacttactaaattggaaatctatgtcaacattaaaaactaagaggaaatacaattcggaaactaaaactatccatgctaatatactctaacatacaactatgtagtatactatccatatctatacatgtagtaattctaaatcacactcttacaacactatagggggattgtcaagacgaaaaaactactgccaaatacatgtactaggatcaacgattccaacacactccatggtaaatgtccacatgtacacactcgcactgaaaccacttgcttttaaaaaagtctataggtataccagtgttcctgttggtatatgaagtgcaccttcttttgctttatacacttgaacctttgcacttgaacttgtattaatcaacactttacaatacacaattacatactaaattgaacattaattaaattgcaaattgaagagaatattaaaccaaatgtatgcatcaaagtggtaaagtgtacaattaaaaagccaatctagacagcaatctggaatgctttttattgtacaattttacgagaaatctaccagttattgctaagcactacaaaataatacacattaaaggatgcgtgcagtctacagataatcacagctcgtaatgtatgccaaaatagttatagtactaaataaattgtatgtaaatgtaaatttcaactaaataaattgttaaatgtaaattttatatggcttgtaaggtttgcatttattacggttcaagcttacaggtcttggtgaaaactaattaactttagcccattatgatacaacataaataatcatcttataaccatcaataagtaaactaccagtactgctacttgtatcacattacaacttgtggcatattactggcatattacattaaagtgttgttactttaaactcttacgatgtcgtaaaattcaacattagcacaccctcggtgggatataaaactgccatctttcatggaggaattttgatttgatgcctggtgactttgatgggtctgatgattttgatgggttttgaggtttactgttaaaaatgactattggcgtgaatgatgcgttgaatgttgattgaaagcaagttgattgaaagcaagttgaacattgatttgaatatataaaatctaaatctatgcgaccaaatatactctaccgatatacatgcacacaccttacatctaaaccttgcatctaaaccttacaactaaaccttacatctaaaccttacaactaaaccttacaattaaaccttataatatatcctacaaccaactacacattacactcgctatagttgcagcagcagcaatattagtttccatgaccgtgctagtgtatcctggttcaattcaagctcaagttcctaaacactaaactaaccctacctattcctactacgtatttcatcctattgtacactcaattctaactatactagtctaaactctaccatcttctccacttgaatcaattgcgttgtcccgtgtacctgtacgataatgtgcaaaatagagtgtctgatgttggacagaggagatgcaagatggcgagagtttgcaggttggaaattgaaatgtagattcttacactaccactaattgtaaattacgctaggattattatattctcaactattcttatagtctcaactattcttataaaaaacatgtaatggtatttcttatacacctactgtatcccatcatcacctatcaaaaaagaaacacattctggggctcaaaaattacatcatttaaatactgatatgtatatataaaaatattgtacaaattatatataaaaatattgtacaaattatatataaaaatattgtacaaattacaaattataaattataaatattgataccactatgctgaataaaaaacattacacagagagagctgttgctgttgatgccgtttaaacctaaaatcgacgttagagctttaatgtgcaattaaacctgaacacacaattaaaacttaacgttcaattaaaacttgaatgtttaaataactctaaatgtttgaataaaactaaatgtgtaaataaaccggcaattaaacctaaattgagaaacacaagccaagagtctaataaagatgctaaaggtgccaaagagtttaaaactgccaaagattctattttgtagactacaatttagagatagtagtagtagctaaactgtacttgagaaaacctctttgctctagtatttatattaaaaaacaatcgtcttgtgtgtgtacaattgttcgtgtcaagttttacttcttacgatgattctacagcctaaattatcattaaatagaaaaaatcacatacttgtacaaatgtgtatgattattgtgtatgcatgttggataaacggtctcgtgtaaaaaaaccatctacaaatccaagcaagacacatctgtatgaatgtttcatattacaatcttacaccctatggttcaattaaatctgtattgcttttaaatattatgtaaaacacacatgcatgttcaattattactattggaaaagtaccaaatccctataccaagatttttcaattttatatataaccttacacctctaacctatatgatttcaactgtattataaaataatattgcaaatgttataaaataatattgcaaatgtttaaaccagaataactaaaaaataaatgtaataataatgttgtaatccagtaccaccacgccactgattatgcatttattcctaggccaccaccaccacaatgattaaatgtttaaaaaaactctagagaccgagtcctagaccgagtcctagagcaactaaatctaagaaaaatctataaaaatccctgatgaataaacaatcaaaatccaccaccaaaacctaagctaccgatcccaccaccatgttataaaatgtgtaaaaaatgtaaaatatcaagtttataaaatgttaaaaaaaatgtatgcatctgcatgcatctacatacatacatacattctaaaaacatgaaatctaaatctattcttggtccaaaattcatagccatgtctgcataaaaggaggagaagaagatgttgccagtgttgttgttaatgttagccttcgcgaggaccatatttcatatttatgacatcctttacgagttgcatacagggaatcttgtttacgacactcctgcgtggagtcggtgaaagaaacggatccattataaagctaacgatcgaatcgatgcggctactccttggctggtccgtgtagccgttcataaacatgtctatggccagtttacgagtcaaccaagggaaatctctgatatcacaagatacaatcaccacggtagcagtggcctcggtattataactgggtgtagttgtagtatggtgaggcaacacaatgatgaatgttgtcatttgagattccgtgctagtcggcatcggggacatggtgattggatttggaatggccgatgcagttatggggttagcggatgtagtcgctgggtttgttgtgcctcttgaagttgtaacagttgtgcctcttggtgttgtagttgttgttccagtactagtgttgggattggtactggtactggtactggcactggtgcttgcaccggtggttactgtagacgtttctgatgccggagatgccggtgtaggttcagaagaggccggtgtagccgcagaggaggcttgtgtagcttcagatggcggtgtctcggacgatgccggtgtagcttcagacgacggtgaagtcgatgtaggctgagtagccggtgtagcttcagaggccggtgtagcttcagattgaggcgtagcttcagaggaggccggagtggcttcggatgcaggcaacacctcttggcccattgccacggaaaacaaacgagacgtaatgtacagcgtggtcagcatgattagattgaattgacgcttcttaccggatccggtggtggtggtgcgtttacccttgtgcactctcttgggtttgagcgcagtcacagtcacactattggccggattgacatgaatcggaatgtagacttggttggtggtgtcgtccaactctaccggatcaatctcttcgtcttcaataaacttttcattgcacagtagattggtggtagaagaaaaagagtaagggttgttggttgtagtaggattagtgttgatattggtgctgctattggtgttgatgtttgtattgttgatatttgcattggcattgatattaccaccactggtagccgttgcagttgttgtcgaatttttaaaattgacatcatctccacagaatggtagggagccattattgtagtgctggttcagatagtagtagtaataatagtaatagtagtagctggccgaagacggtagaggcggctcagtcgggttcttgatggattgctgttgttgttgttgctccatcagagtcggttgatcacttggacccttttgctgccccatcaacgcatgttgaccaatccaagcgttttgatccatcgtacagggacagaccactccggtaccgtcaagtttggtgcctgcgtgagagagagaattcaattgttagtattttgtacaagcttgcactttacttgataaaaactttacttgataaaaacacacaatacctttggataaaaggatgaaaatataaaaggtcttagagagatgtataaactctttacattaataaaaacacaattgtacaaatccaaaattatacatttaatcctacatacaagcctatacccacaatcctacacctacaatcctacacacaaccttacacgcaaattcctacattcaatcctacatgtaatcctacacattccatcctttgccatcctccgttaccagtctttacccctataaaaccatttgaaattgccaataaatcccaatctatacaagtgcataaaattgaatgccatgtctaaataaaactaaaaaaaccctacattccatacgtgtacacttgctaaatgtactatacagttcactgacccaatttcttgaccttgacctacttttgagccatgactgacattcggaaaaacatcattaaaacactaaccgtttacgataaactccactccttgagcagctccatctcgtcccttggcgtcggcggcggcgtcggtggggtagcggcgacatttgcaccagtaacagttgcagtctggtactcgagatagctctcgttcgagctcatcaggatcaaaatgtgcaatcgaaccattaggttgacgcatcttataaatgtcaccgtcaacaagagcagtaccacgaccgccaatatcatcaaaaaatctaagaccatccttcctcttggacttgatcggcgtgtaacccattataatacctcgcacatataacgtattgtagttttcagatgcaacgagcttacactataaagactatcgcgaccgcactctttcaatagagaacttgaacaagactggctgattagctgcacttgctcggtaatttatttgacggacgctcacagagatccaacctatacgtacgctaaacttacactcactagtatgcgcacacatcagtcggtgcagtgtgtgtagtgtaaacattaataaaaacctacaaactatgagttttatcaatcaaaacactggtgaactggttccgcattcggaactgaaacgatacgatgaggtggcattgatagaagcctacccagactttattgccatacgcatctattccaagacaaagggcccgaatcaacggacggtactcagcacaaagcccagtggaggtagaaaaatcaacgcaatccgactggagggtaaactctacagatatcgacacgtttccaaccagtggttgacgacttttttgaatacaaacaagaagaatattgcatttgtagtacaagacaccaccactttgggtgttcttagtcgccaagaaattttggcgcacatgaatttcatggcatttttgaaaatctttgaaaagtgcaaaaattcatttgaatttaagacaaagacgatcgaagacgtgctatttaacgatgtttgggtcaaatgactcaaagactgtgactaatggtcatctattgttgaccaagatcgttaaatcttggaaatgattagtgtgtgtgctttgtaataatgtaatgatttacaagtatttgtgtgtttgtttgatttttttaatcaagaagtaggatttcaagtaaattcaataaactaaactgacattttcgtgttttttaatcaaaaaaaactaaaaactgcacaaagtggttaatttcaatgttttattcaaccggtttctatgaattaaccgcaatttaatagcctagagaaattaaaaaataagcctagagggtcccttcattttttacaaagttgaaaaaataaccatcgctaaccaacattacaggaagttgtgcacctataatcatacaaagtctaaaatttagattggatttctagcatggcaattaaattgtaaatttacacatttatgcaaatttctaaactatgtgggacttttacgtatccgtcaagtatttatgcaaacggtaatgtctccatttatgccaatccttgttcctcgtacagtttggtttcgtgctccaccatgcgataaaagggattgttgcactctttatgtctgcgcttgttgtacgttgccggtatgactatcggttgcttgcagtcggtacagtcgtccatgatgggatacgcagagtggtagttgatgacggcactgggatcgcccttgcacatcaagttttccgtgtttgaaattgcaatacccaaatcgacggatttacacgatctcatgtacgaacccattgctggatcgcccattataaaggtgaacatgcccttttcagtgttgcacggctcaccctgaactatggcagtctccttgagtctattgatggatatttcacagatgccgtttatacaatcgtacaagtgattcatcttttccatgcacgagttgaggcattgtgcatcggtgaaacaatacaccttgtccactgaacagttgctcttgcgcttgccatattctagtcccgtcttgagagttgctctattcttagtggtgttggtgttgtctttgttgttgtttttggtagtgttactatgacagccaactgtgccaagttgaaagtaaaacacaagacacattacgagtgccaagagtgcaggcagtagatattgcatcttttctcatccatctatgtatcaagattaaaaaaattaaactcggttaagctataaagtttttcaatcagtacacttcctgtgctacatacagcaatcaagtttacattcctacatgcggcaattattttttattctacaattacatttagtttgaatgtggaatgagaggggtttgattgaatgtggaatgagagggtttgattgaatgtgagggtttgattgaatgtgagggtttgattgaatgtggaatgagagggttttggatgttggctaagagttttgattgaaggagggttttggatgttgactaagagttttgattgaagaagagttttgaatattgactacgagttttgattgaccaagagtttgaattggttaaaaaatgtacacttgacagttgcttaaacttttacttggatattctacactattggatactctatactattacatttctatactattgaaaatgccatctattctataatatttgatagtctacactattgaataaagctacaccatctacattactatcctaagacgaacacaatgcgattccaacctcggacactctaaagttgaccaggttgcgtgaaaagagcacattgacgtcgtcgcgagcatcaccggcaaacactagcggagacgctacatcagtgtctcggttcacgtcatagtaggcaatcggattggccacgatatcgtgattgatcaacttgaaggctctcgcatccaaatccaggtacagattgggtggaaacgatgtagcctccggaatgtagttggtcgacgcttcacagttgaagagcaaaatctttataatctgaggcatcagcgtcatgctcatctctatggatccgtttcggctgtaggcaaagatgcgagtgttggcaaatctagaattgagtgatttgtcatacttgtgaatgtactgcatgtagtcgcggtactggttcaggtacatgttgtccgagttgcgactcatgtcttgagatgcaatcagattctcggtaaacattaccgtcagaatctgagtcagatgacaagcagaagcctgatccacatcgagccggctcacccatgcctgcatctctgagattatattttcgatggatggcgatcggcacactctaccctccgacaccgagtacgggaacggaatcagtttgttgtcacccctcagattgggagtcggagccatgtacactttggtcttggccacattgttgatgacgacccgattcttgaccagactcatcgaaaacaacagattcagatgggggttgcaaatgattcccgccaccggtagagtgcatctgacgtatacattttgaaaaatgcaccgctgagcgcccgactgcgagctagttgaacagaacatgatttccgctaaatctataaacaatgacaacgcccatagtctcaatagtataaatagcgtaatatcaacagtcggttattagtaagcggttgaacatttgaagcggtaacacgctttttagcgttcagcagcaaacatggatttttacgcaaaaaccattgtcgacgagtacaacctaaaaatggacaaattgataatctacaattgtccttgctacaacgagtacgtctacgaagagtctaagcgcgtagacggcgaagatgtgattcggctcttgttaaagtacaacaaatcttatgctgcatgcatccaattgcactgtagcaacaatcaagtgatcgtcaagcacaaggtcttgccgataatgattggctccaagattgacatgatgattagacccaatgtggactttaagcatcagctgggagcctttgttttgaacggaggcatcaagattttaccggccttcatcaccaacaatctgcgatgcggccacgtgtaccgaccgagcaacgagtacaagtggtatctcaacgaggacgtgcccgacgatgccaacagtaccattgtgcacatgattcagtatccgcccaatgtggccgaatcacccgtcgtggaatcgggcagtaggcgcagacgcaagggcaactctacgattgcggcggtcaacactcgagtcaagctggtgagcacgaaacgaatgacggaaaagcgcgtaggagtccgaggctatgccatcaaggacgattgcatagtggccgacaataccgatgaggaaatctttgcactcataaatcggctaagcccggtgaacgcaatcactgacaatgcgcacactgtgactccagaggattatattgatttttttgagtgcagcatcaacaactatccagagctggacgatttgtgcaacaagactataatcacaccgacctccatctttgagacggccatcaagaaatggagcactctaccgcaaaactcttccaagctgggcactctggtgtcgggtaatctgttttacacgctatcctcaaagacggtgagctacatcaagaatgacgagttcaagactgcctacctgtcggtggagggccaccgagtgtcgatgatcgataagctcatcagtacggtaaagcgacacattaatcacggtgtgaaaaactcgaatgcactcaaactgccacgggactcgtccaactttatatgtccgctcaacgtcaaggagatgaagaatgccggcgagacgatggctctagcgcagtttgtaatgattgcaccggccgtttcactggagcggatcgtagactttttgaacgaccaccacagtccagaggcagagttgcgcgtagtgatcgagggctggctcaccaactatcgcattcggccgtgcgatgtcatcgaaatgaagcgagccatgatcgtggtgaccatggtgtacgaggatcgctatctggtcgtgtaccatgtaggtcacttgccggtaaagtattcgcccaagtatcgcatgtttgtgggcgtacacgaggccatgaacacttaccgagacgcctttgagggctacacatcgtttgcggcctacactacgtttgcgatgaactttcatcgagccctgttgcacatgccaccggcaaaggccaccgtctccatcaacaacatcaagggttcgtgctctacgctgacgagtcgatccgatctgcacgcattcatccactcgatcggattcaccaactctgccgtgatgaccaccaatattggcatgctgaccgattgcgacgacgaccgagaaaacgaacgtcaattgggcgaagagtttgagtgcgtcagctttaacgattcctccaagtttatgctggccatcaaggcggcggccacaaagtttacccatttggccgagattcagcccgagtgcaaagagtactatatggaggctcccgagacggtgcacgagtttttcaaagactacaatcgactgaagcgtgaaaacttggccataaccgatggcagggccgatttattggatccttgcatggtgggtgccaagacctttgaggaggagggccagtgctaccgagacttgtttgtgcacgatgccgatgaacactttgagtgcattcagcgtcagttgagcacaatcaagatgcaagactacaatgtgctacccgtaccgccggggagcaccagtaaacgagacgagtctcggtacgaagagtgcatgcaaatgaacctggacacgtactcgaacacgaaccgtatgctcttgtacacggccctgtgcaatctcaactgtgacagtgtagaggatggcatcattatagatgaaaactttcatcgcaactcgccactcaaactgttttcggtgactctactgctgagggtgtacgctcacactgacgacaagtccaccttttcgcacaaggccatgtctctgaagcccaacggcacctacaagtatataccgatcaataaaaagtttgacggagtcattgtgtttggagtgctcatcacagaccaccaggtacggatacagcgacgcagatcagtctatatacacaagtcttttataaagaacacttttagatatctaattacaatgagtgatccactgcgcaaatccaagactatagactctttctttcaaatcaacaataccaatcaaaagtcgatgatatccatccactaccactatacggaacgtttgggcgttggcaccaagttggccaatttgcacggacaaaagggtatcgtgtcttcggtgaaggatctgtcgcagtatcagttttggaccgcgtccggaaagatggtgcatccgcagatattgtttagcaaacaatctctggtgggacgtaccacgtcgtcgcagacgctgagcatgctcaacagtccagacttggcggtgaacggtgacggtgagatttgtgcaccgttggcctttttcgtgcaccagatcgaggccaatgccaagtgcaagcaaatgtttcccaagaacgatctgatgacggccgagaatggtttcgtggccaatggcctgattgccacgatgaatctcatgtccaagcagtatccgctcaacgagagcatcaacgagaacgcctttgtactggatctaatcaaactgggccatgtgcacttgaatctgagcccagacttgaaggcagtacagggaggcggtggtggtgatgggagtagtgttagtgtggatagtagtagtagcagtggtagcagtagcaatagtggtagtaatgtcgatggcagtggtgttaccaaaggtgaagttaaaggccgagacgaggagggagcctttgcattgattgaaaagtgcaaaaagaccaagagcaagggtgctgcattgtttggtaaggataaatgcaagaaattgaaggatggccacaaagagtgtaaaacaacaaaggatgctaaaaaggatgtggtccggagcaacagtaccggtagcattaaacgcaaactggaagatgaccaccaacacaagcctaaacgatccaagagcaacgaggcaccggtggatctagactcggattccgagtacgagtccatattgagatttaccgacgacgatgacaacagtagtgatttggactcggagttggacagaggaggttcaggctctgagattgacgagtcggatgtgacaaagtgtgagcccaagtctgagattaaaactgaaaaggacatcaagtctgaggttgaagatgccgactacaatgaacagcagcattattcggatgacaatgcaagtgtcaaatctgaagagtgcgacagtgatgttgatggtaatttggaaaagctagaagccgaatcggaggcctctgatttggaggacgacatggacggagacggggacggagacttggacggtgacggagaggacgagtacgatgatgatgtcaatgttgggatggatgattgagggggaggaggaggagaatggttgtttagtgttatggtagctatagttttgtattctgtaattttatttatattctatagttttatattctgtagttttatattctttagttttatattcttgtaatattcattcttatttttttaatatccaaatgttgtttaataaaatataatcaaatgtagtgtttaaaaaactaaaactaggatttgtacaattacattattacttgttagattataacaaccaattgtattaaactacactattacattaaaatctacttgactctatattacaatcttttatttaaaactcctttatttacatgcaaaaatacatatacacataaatccatacatccatacaggcacccatacagacacccatacatacagcaagttgaggttctcgacattagattcttgacattaatccacctttagtatcagatgctatacagagagagatacctctatctgctacataaaacctcctgttacattaacctcttacacaaaacctcttacacaaaacctgcattaaacggtactcgctttctctcaatccaatacatgcaacacatttcgcacctcttcaaataccgtccgggtttcattcaacagaattagatattccaaattggaaaatttaccaactagtgtggcgtcggctgtacatagtgcagcatgtacactggtgtgatcgtacgattcaaacttggtacgcatctgtttaaacttgcacgaattggtaacatggcacggatacactgccgactttatgactgcactattgttggcatttttagcattggcactactactgctactactactgcctgtactctttttcacaaacaaaaactgtttaatcaaattgttgatattcttgatgaacgccttgagtgcgaccgtaaagtttttctccaccttgatcatgttgttgaagagaaacagtgcactcgtaccgtttacgtgcaccgcattctccaagtagagtttgggactcttgttgagcagtgcgtgtgtacaattggaaaagagcaactttaggttttgcatcagcatactgtccagcagcactcccacaacggtagacgaggccggctgcagttgagctgcactacacagcaccggacacgatagactctcgtagatgcgttccacttcacccttcatgttcagacggtactgtactcgattcgaattggtgcagtctttgagcaactgcctagagcacccgtacttgaagtagattacgtgaaacagcatcaactgattgcccagaacaatgtactgatagttgcaagttatgctctggttgaacatcgagtctatggtgtggttgcacgacactgcagcgtaaatgtgcacctgtggcagatcgtgagttggctgctcagtgtcgtactcttgtaggcttagctgctttttctccatcgcatcagacctattgtaaactctagatcgtacaaagtgggcgttattgacgcgtttagatactctaaagattcgttcaagttgccctttattctaattagattgtatacccgcaatatctcattggtgatttgaaccattctaactattgggtaattcattgctatgatggcgtcgtcgtcctcgtcgaataggacgcttcttacaaacttgcaaaaactcaaaatgttgacactctccggcaacgaatgaacgatttttacgattggtgcacaatcggaaatccaagtgggctccgacgactgaggcagcgacattagcggatcgtaaactgtttcatagccggaatacatgaatccctgataccagacgtgaccgcaatcgtcttgctcccccaggtccacggtcgtagactgtatgcgtttacgattgattgaaactatgctgcctacgtttacaatgtatctacctagaaactcaaacatggcaatcttgaatagggacattaagttggattgactaatgtactcgttgctgaagcctcggctctgtttggtgaaccttatgtaatgcttttgacgaatcttgtgatatttgtagtttaaccttaacctaaagagaccgcgttcatcgctgcgctcaaacagatagtagtacggtctgagactgttgccttcgttgttgtacagatgactcctggcatttacgacatctttacaattgtccattgtttttgtaaaatactataccttgcaattttccaattatatactgaatacggctcaagtcgtttcatggcaccaaacgtttccgttagcacgatagtgacaatgtgttattacaatagtccaaggttgccattatgaaatgtgccattaatcatcatgcctatggacctagagtttgtcaagccggacaacgtgaagagcatcgctactattgcgctaaggcatgcacgcaagtgcaccgacaccatactcttgcacgtttccaatgtgcccgaacgtaccaaactgtgtccgtcgtccatgtacattagaatgtatccatccaacaatggctaccgtactctgggcacgaccatcaagaaactaatcaaaaccactcagcaacaacaacactataatgttataattctagacaccaacaagagtcaagtgttgggatccaagattgaaaagtttcacgatgcttgtgctctatcgaacgtggtcagcaagattacctatattgtgactggattttgatgggggaggtgtgtgtattgtattgttttgaattggattggattgaattggattgtattgaattgaattaaatcagagtctaaaaaacaaaaagtattttagtttttattaaacaagtttattaaacaagtttattaaacaatttattacaagcatagattgtttaaatgtctacatccttatagaatgccttataaaataccttacaagtactacatgtacacaaaccacttgtacaatcatctaccttataattaaccctgtatgtatatccatcaactaaacaattcatgtacattttttaaacataacaatttttaactggttttaaatgttttttaaactactaaactctacaaccatataaaccaactctacaaattacaaaacctttctaacaagaacacgacgtacacacatcatcaaaacaaaccatttgattgcgtccagtcaactctattgattcctttggctctattgattcgtttacctctgttggctttggctctagttgacacatttgagaattgttttcatcatcctttgatttatcatcaatatccatgcaaatctttttagcatcactatcgaccaactcaaaggaaggctctttgcgtttacttaaattctcaacagaatttgctgcatcaagtttagcctttagtggcgccttggttggattctctgcaatctgttgcataaacgtaatgtgatgcagtgaacgtttagagcgcatggtacgactgaggttgcgctttgttccagtgctgctaggattgctactaggattactactactagtactgttactagtagtactactactagcactactaccagtagtagtagtactctcaacaccaccactactaccctcaaccaccaacaaagacttggtaaacggtgaagccataaccctgccagccttcatttgactcatcaacaaggcacaacgattcacgtccaccgtaaatggtatggcattggtggccgactttgttctcagatagtacatgcccgtcttgagacccttgttccatgcgtaaaagtgtatcgaagtcatacgactgtaggtgggctcggcaacgtacagattgaacgattgactctggtcaatgtaggcacctctatcggcagccatatcgatcagcgtcttggttggaatctcccagacagtcttgtagattctgcgcaactcttccgggatgatggtaatgttttgaatggacccattgttgtacatgatcaactgggccatgtcatcgttccacagattgagccgttccaagtctcgaaccaagtgcacattggtcaattgaaactctccagactgggtgcgtctctggtacatgtttgacgtgaacggttcaaaagattcagcattgccaaacacttgggaagtggtagccgtgggcatcggtgccaccagcaaagagtttctcaaaccgtaccgagcaatgtctttgcgcaacgatgaccagtcacacttttggctgtgcaccgagtatcggtcgaagtgcaactctccacgactggtcgggctgccgtggtacgattcgtagactccgtgcactcgggccagttggcagctctccgtcagtgctgcatggtagatggtttcgaaaatgtcacgattcaattgcatcgagtcctcgtaggctatacccatcatggctagagcgtctgcgtagccttgcactcctataccgatgggtcggtgcttaaagtttgacttggccgccgagggaatgggatagagtgcattgtcgataatcttgtttagattcctagtcaccagacgtaccgtctttgccaataggttgagattaaacactttaccctctacaaacttgggcagattgaccgatgccagaacgcaaactgccgtctcgtccggagaggcgtactctacaatttccgtgcacagattggagcccttgatggtgcccaagtggcgttggttgctgttgcgattcacggtatccttgtagagaatgtacggagttccagtctctacctgagccgtcacgatggccttccacagttctcgtgcatcgactcgtctcacgtatcgaccctcttgctcgtaggccgtgtacttggcctcaaactcttcgccccagcaatcggacagaccgggtgacgagtcggggcacattagactccagtagccaccgtcgttgacgcgcttcatgaacaaatctggcacccagagtgcataaaacaagtccctggctcgtgcctcttcaaagccagagtttttgcgcatctcgataaagtcaaaaacgtccgcgtgccaaggttccaagtagacggctatagcgcctggccgtttattaccgccctgtgtaacgtatcgtgacattgcattgtacattctgagcattggcactaggccactggcgttgccgtttgttgaatgaatcgtagagtttttacagcgcagcttgtgcacatgcaaacctacaccgccacagtgttttgaaatggtggccgcgtcctttagcgtgtccataacgccaccgatgctgtcctctttgagttcgagcagatagcaagaggcatagttggaacgattcgttgccgcatgacacagagtaggcgtcgaatgtacatagtagcggttcgagagtagattgtacgtttcgattaccgattcaatatcccgaccgtgaataccgagcgcggtcctcatgtacatgtgctgtactcgttcgcaaatcttaccgtcggccagctttatcagataggtacgctctagcgtcttgtatgcaaaataggtcaaagattgaaaatcgcgatcgtctacaatggccgagtccaaggtgtctgcatgctcttgtaccaagtcaaaatagtactggggcacaatgttggcctcgtacaagtctcgaatcgtttcggaaaacttggaacgagtacgtttgtgtagcgcctgcatggctatgcgagcagcgagtatcgaatggtccggatgcgcggtggacatggaggcgcaagtttcggacaacagagtgtccagctccaatgtcgagactcgatcgtacaggcccttttcgacatcggccacgatgcctgcaatgttgataaaggcggtggttaatcggggctcggacatggtcatgcatctttctatcctagcgtacaatttagatggatcgaatcgttcaactgaaccgtttcttttgacaatcattctaggattccgactcattttcaagctaaactagctaaggctttaataattacccaaagacaaataccaataccgtattgtacctaacacatcatctgaaaaaagactaaacgcagtgtgttcaagtggatttatttaataaaacaacatcaggtttacatgaattaaattacaaaatatagagtaattttaattaaaatcttaacaatacaatacaatacaatacaatacatgcatacacaaacacattggcttacacctcactagcgggtacatagtaatctatcgtctttttgtaaaagttgccggtagtgttttgggcaaacagactcttgtaggagcgagccacgttgtacgatttcagtgctctagagcctcccgtcgtaatcaccggaccatacttgttcatcatgatgggtgtacgttccacgtgcactccctccaactcgtcaacgtccgtattgtagagatccctaaactctcgatagtaggatccgttcaccgagagcatgtgcacgccgcgtttgatgcaaatctttaccgaactatagccgcgattgtccaacatgagatcgtacacgaaaccgctcttggccggcaccatattcatatcggtcagagtttggtaaatgtttttgaccaacgatctgcgatgcatgtacgccttcatgtactctttaaaggtcttttcgttcttggtaatgtttagaccgttcatgaagctcgaccaaatttgcgtgtgcatgtacagagagttcatcggtttggtgtcgtgtagaaaatccaacaaacccttgacctcttcacgcttgcacgacaagagcaatcgatgcaggcaactcttgttgttcttctttgaatagtaaatcatgtgcttgtagctttgtctgatgcgatggtccatcttgttgggtttgttgcgcttggccttgtcagcatccgcctcctcaggctggggattgttgtagactcgtaaacgattcgcaccattgatgctgctcaaaaactggtacactctcatgatgtagtccaactcggctcgatagtggatcatcaaaaaactcctacactcgcgattgcacaggtactcgagcagagtgcgattcttaaagtgtctcatgtacgcacgaatgtcatccgtgtacttttgtgcaatcgattcgtcctcctgagagagtttaatctttttacaatcctcttgaatcctaatggcattgtgttccatttcggcttcgagtcgcttgtacgagtccagagtgcgtaaatccttggtaacgtacaggcactctttgagagacacaaacgatgcctcggcctcctcgggggtcatcttgcactgtgcgcaaacgccattgttgaatcggtggcagcatctcagattgcgcagagtggcatcgcgattcggtgcattgtcgattaccaccttttgtccacccttgagcttggccaacgtcgatgaatcgtccagagcccggctgagtgcatagtcggtgtactcttcaatgaccttgttgagaaagagttcctttttaaactcgttgattatgcagtgcacctgactcttgtactgtatatagtttcgatccaagtcattgcacgccaccgatttataggtcctaaatttgagcacacaccaatccgtctcaaagtcacccttgatcgtacgaggacgcttaaacatgccaaaattgacattttcaatggtgtgtactccactacgtttcatggttggtaaatgtaggtaccggtagtaaagagtaggtaaagagtaggcaaatagtaggcaaatgtagatggagtaggtatcgtgctaaagtataggtataacgctaccactagtgtgtttgcactacaaataacaatggcagactgtatcgacaccgtacgcgcaaagtgttttatataacattcaaacgtaaacatatcgataatacggtattgcccttaaaaggcggtgatattctatagattcgagcattgtaaagctttgctttaataactgagactactcaaacacttgtaacaaaaaatggcttcttgcactttcaagactttgttgaacgtagactcggagtgcagcattcagaaatgcaaagactactacaagaagctcctcaagggcatcaagaccaaaaagggtaaatccaaggtgtccgtgtttgtgaatcgtctagtggaccgtccctatgaggctctgctgacggtcaaggatagcgatactctgactttgcgagtgccttctgcgtttgtagactcgatgaaactctaccagtgcggagtcgtattgtccggtgtgttcatcacggtgccgagtacgtgcatcgtgatcacagaccaggcgaccgacgatgccccaatcatcgtgtctccgttcgcattggacactcacaatgccggcgagtttggtgttgtcatcgccaaactcagagacttgaacgatgccgagaaacaagactcgcacctcagcatcgatctcaagattaaactcataatggttgatcgtaccgcaatgagtacccacaccaagccggccgatgcacccaaggtggccaaagagttgcgtcccgtgcacatgggctgtcgtcgcgatctctccacctttgatcgtaacctgtggaagattagcaactgtaaaacactggacaagattcccagtggagtgttgccgttctctaggcaaagatccatcctgaacggtgatcaatttatcggaaacaactactatagaaagactccgtccgccaactcgctatcactcaacggattcatacccaaggtgattgttggcaactttgaactggtgcagcgtgactttaagggcatcggtgactttggtggaatcgatcgcggaaaccccaactatgacgagtacaagaagctgttgcgtactcaccctcgtcctcccatggacgacattcgcaaaaagatgatggaaacgagatgcttggaggaactcgagagcggaacttgtcaaaagcgcaaacttgacgtaaaggctgttctggcagaggacgatggactcgatggggaatctgctgcaaagagggtcaagattgaacaaagtgtggtttagatttagagtatagatttagagtttaatttagagtatagatttagagtcaacttttgtaacaatccttagactaaaaatgcaccattgcactctgtaacctttcaattctgtaatctattgaatcccaacaataaaggctatttttttagcaactcgttatgagttttgattgcactcgaccttgtcctccaattgtacaatacacttactcatagctaccagtcttatcttgaggatacaaaaccaaacacctactaaacaaatgtagtttacatgttttgaaattatcattgtacacatttattattgcattgtacgtgatactacacgcacgtattcagggtttagaaaaagtatttaattcagtaggtggtctagttattttttagtacacttccggcagcgatcatgaagaggtctgccaacttttcaatgtcatcgagttcggaggatgcgtacgcagatgcgcatcctgccgccaagagagtcaacaatttcaactcggtaggattcggcgatggcaacgggttcggtaaacgattcgatagcactcaatcgtccaccgatgaggactcggagattcccaagcctgtgcagccgagttcaaagagcaccaatagtagcactttaaagagtaccggttctgctctgaatcctccaagtcaaaagagtttactgaatccaaagagtatcgcgattcaaaagagtactttacaaaagagtggtatacacaagagtagtgtacacaagagtgttgcacaaaagagtgttgcacaaaagagtacatctcctcatcaaaagagtactacccaaaagagtacatcacctcatcaaaagagtcctctacctcaaaagagtacaaatcaaaagagtacaaatcaaaagaatgcactaatcaagagtgcgattgaatctagtgcaaagagtgccggtttaaagagtccactgaacacacaggatggcgtaaagagtccacaggatgggagcccggatagtgcaactagtacaagtgtaaagagtagtaatgaaaagagtgtaggcgccggtagcgctagtccaaagagtagcgttagcagtggtagtgtaaagagtgtaggtagtagtggtagtggtggtagtgcaaagagcaccaaaagtaacattagtgcaaagagtaccaagagtaacattagcgcaaagagtgctaccagcagtattggtagtaatggtagtggcaagagtacaccgagtgctaataatggacagagtggaaagaataccattagtggacagagtgtgcaaagtggaaagagcaccattagcacacagagtgccaacagtggaaagagttcaagtttaaattcaaacagtttaaattcaaacacaaagagttcaagctcgggcatcgagtccaataataatgccaagagtgcacactctgcgtcaaatgtaaagaacaagagtgcatccaataccgagatggttaaaaaggattgcaaagagcccaagcaaaagcagccacaacccaaggagtccaagccgagtctagctcaacaacctcaaactcaggagtccaaatcaactcggaagcaacatcaaaatcaacctcagaatcaaacgcaaaagcaacatcaaaatcaacctcagaatcaagcgcaaaagcaacatcaaaatcaaactcaaaagcaaaaccaaactcccaatcaaaagactctggcacacattgcatccatgaccgagaacaatcccaattgtgagatggagtacgaaacctactttgcactaccagtctccactcacattggcgagtgcatcaaaaagaacattgcacgcgtagacttgccacatcgtgaagtgtgggtcatgtactttaaggacaacactcgagtcaccggcaccacatctcagcgcaaacacgtaatctccaaatcccgacacttgtacctgagcggcacgatggccacaccgattgtgattcccatgtgtcgtaccgtatcgatagaggagaatgtaccctttacggcatccatgagcgatctctcgtcgatggtgcaaaggtttgtgctgtttcgcaacaacaatattcgcatcagtctagagtgcaggagcaacggatccggcaacgagtactacatatcgggcgaggtagagtacacgctagacgtgctcaatgattttcacggactgcgcatgcaagaagcggcactggtgtgcgaactcagagacacactgggtcagtactttgcctccaatgtggtgtcaaacataatgtgcgtactgcaccgattgcaaccggccacgcacgattccgtcttcaagatgccgtgtcgagtcttttccaagtttcacaaggtgcagatacgcgacagcaagagcttcatctacaagcacaagtatgatggcttcaagtgtaaactggtgtgcaccgagcccaacaaggtcctctaccaggatgacaacatcaagtttatacagtttaattcgtcaatcttcaacactgtacccaacctgtactttcaattggagaacatgtgcaccaacggcagaaaggaatcgcaatcctcgtccgagggcatacccacagtgataatcacagacgtgctgggagtgcgtctcggcggtcaactgttcatgcccgaacccgaagaggtgctcaagtttctgtccacgttcaatcgtcaacagcagtatgtaaactttggcgatggctgcaaacgcatcctggtgcaagagtccatagacgtgaacgcaaccaccaagtttaagcgagacggactcattgtcatttatcgcaacaaagagttcaagttcaagtttcccacctttgatgtgaagctcatgaacggcatggtgtacgtaaagaatagcaacaacatggacgattcgctgaatctgattcactatgacaatatgccggatggcatctatgaggtgtcgtttgacaacctgcaagccggcaccagcagcatgtgcaatcagttgacgtttctgcgcagacgcaccgatcggctgactccgtctactcgtgccgaagtggaggaggccatgcacgagttggatcttatgattggatgtgtgtttaaactcaagggatagatttagattttagggggagatcgtattgtatgttgatgtatgttgttgtatgttgatgcatgctgttgtatcttgttctatttgcgtatacttgtagtttaagaaatgtttgtagatgtagctgtaacacatacttgtaactgtaagccatactggtaactgtaagacatacttgtatccaccattattctaccaaataaatacatataaacatttacattttttagtattatttaaaattcagtaatcgagtttaaaaaaatataacaaaaacgagttgaaaaaaatagaactcggcgcccagtacctatatatataatatatattatagtatagtatccccccaaataatactatagtacgatacttttgttgcatcttgtacgacaaatggctgcaattactgctatagcaattgcacccaaagtcgtcaaaagtgcacaaaaccaccgtctacagtatcatcttcaaaagccctaaaaacgctgtttttgcatgcctgtgcgaaacaggacagcacgcaagtcaaaagtcgattttaccaccaaagtgcgcaaagtgctcaaaatgagccatctgcacactcggtgaaatttgatgatttctgaccaagttttaagccagcttatccaacgcctaacgtaatttacagagcaaacgcaccaaatgtacgtgaaattgcactgaaattgcgtgaaattgtacccaatttcgtgttaaaattacgagtttaaaaagtatgaactaaaacttgaaccgaaggggttcacaataggatgcattttacacattacggcatgtcacagagtgtagttttgcgcacatttcatgcacaccactacacctcaccgtaccgtgcaaaatgcacacccatcacggagacggtcaaatgagcccgtccgcataatacttgcaccacaatataaccccaataccgtattggctctatagtgcacaaactgtataaaaatgaaaatgcgcaaaacacacgcaaatgttgaaaattcacgcaacccgtactcttgctattggttgcacggtaggcgtttgagagactacctttgaggtcatactcgagggttgcgattgaatgttgatgaaaaaaatagaatcacaagcaatcgttacaaatacaaacaatcattacaaatctactacacataattttacaagactactagtacaaatataaactaatgatatctcctagtaaaaactaacactacaataatccacaacctaagcatcatactcgtcaattgcattatcaacctctacctgcatatcgtcaccgttcaacactcccccggtaccgtacatgttgagtctggccatcgcctctggatagttggcgtttagcactcgtatccattcgcgttcatttctcgccacactagactctctggcgaaccggtagagggtggccctcatgcgctcctcttcggcagccgtgtcgaccacgttgtccgtgtctcggatgagtgaattcaaacgttccagcgattgctttagttgcatatagtcggccatggacattgtgccgggatcgtctactcggaaatcgatcacatcgcgaaacaccaccaccggtgccttgcgtcccactatacgaatcgatcccatcgcattgtccgaagtgccgatgccgtcaaagagcgcctgagccggaccctgtccctgagtaggttgttgttgttggtggtggtgctgttgttgctgctgcggttgtagcactggaccgatttgagaactctttacgctgccgagtgcgtttgtagtctcgggtcgtcggtcggtaaaggtaaagtttaccggagtcgcatgcttattgatcatgtacggtgcgatccaaaaataagtagacttgaagaggtagttgtcggcgtctacactgacctgacccttggtgcgttcacggtacacgttgaacgagtaccgatcctgcagaggatcgtgctgcgcacccgtcctgtagccaaaagtgatgggattaagaaacatgatttggcaatgtgcatatcactaaactgaccagtatagataccgacaacaccgtgtacgagttatgcattcgaaaaacaatagattagcgtttgtcaaagggattgcgtatgacgagtctggagggtttgcgcacagccaccgcctttttgtagacgtcgcacaaccgtgcaccggtgcacactgcgactcgactgcccgcctcgtaaacccctagactcgtcgtccagatggccatcatgagcacatctccaatggacgagtgcatctttgtcagcagatagtagttttgccagtcgctctgaatcatcttgaacagagcactgttggtgtagctagagattttagcgtcacccttgcgattcttcatcatgaccaacgagtctgagaaggccatgtcgctccagtaggctcgatcgttgcgcctcaacaggtccaggatgattttgaaatcgtactggaacccgttgtgggcaatgtaaagtatgctcgaaccgaacctcgaatgcagctcgtcaaacacttgcaagtgcaaatctgtgcgtacactcttgacgcatcgagcatagatcgaatcggttcgtatgtcgagaccctcttcgagctgctcgtacacgcttcgaatgtgctcgtcggtgagttgtaccactgtcgagtccaccactagcacggtcagatcccgtataccgggcacggcttcgactccgcactcgagagcgtacatcttgccggtgggctcaatgtccaggtagcatcggtagcgatactgcatcggttggtagtgcgacagccatcgtttgtagtcgcactggttgtatttgcgatgaggcaactctttgtaggattccaccctacacttggcatcggagagaagcctaacgatgccactattcggagaatcccaattggtaaaattgccagtggagaatcgctttgatgctggtttaggggttttacgactagtgttggcggtggatggcattttacctggactgaatctataggctaatagtctcgctctctacgaaatggactcgtaccccagacacgcaatagctccatcaacgtttctaaacaatttcaatagcgtataccctattggcgtaaagctcaaatgtagcaagtagagaggctgaaaaaaaacaaccacccgtggccagataaaagctgaagcccttcaaagcacggtatcatttgcattttgcaagtgtacgagaacggttgtgtacttttagagcggaaatcaacatttgctgataagatgcaatctgaacaaaatcagcacaataatccgctcaatgtgtacgagctggaggatcattttagcatagattcaaacttgctcaatagcgagaccatcaatagttcactgtatcggttggcctctttggatgcctaccgaaagtacaagaccaattttaagattgtcaacattagactctctttgaatactagcaactctacagtgctgtactcgtttacgacatcggatcccagtgttgtagcgattcacgagtctctacaaaaggaacgcgaaaccaatgagattagcctgcccactgaacgattcaagactcgaatcgaaaaggagggctctcgtgtaaagtttgaaaagttgtgcatgacctatcgtgatccggacacgcagcgagtctactttaggactcacaccggcaaagtgtacgacaatcactatagcctgggttgttttctggaaaagaggcccgatgagattcccaccattgacattgattgcgatcacgtcttcaagactatagagcaacagaccaggtccggcgacgaagagattaccgtcagcaatatttgcatcaagtgcaatgcagacaagaagaatctacgatcgatgccaaagctggtgaagcgcgatcaattggaggtgctagccaagctgctcaatgttttgactgatcgtgagtttgactataaagagtcccagactgttactcatttgttttcgatggcatagggggggggtgtggaggatgaggatgtttagtgtgggtgtttaatattgttaaaataaatatcttgtttttaatcatcttttattttcactttaatattacaaaggaacattattacttaattacttaatattttaatatgcaaagaacacacagtaaaacgtggcgaggagagagaacattgacaatagacaacagagttaccatagttttaatacagaagaaatataaatgtaccacagatactaacaaatatcttgtgtttgtaaaataacctgtattatgaatctattgtgaatctcaaagtaagcttgtattatgaatctcttatgaatctcaaatcaaacctgtattatgaatctcaaagcaaacctgtattatgaatcttttatgaatctcaaagcaaacctgtattatgaatctcaaagcaaacctgtattatgaaaggatctcgatatacatgttctctactctgaaatagcaatactctgaaactctaattcaatactctgtaactatatactcttttaatctatataactcggcgtatgtactctttaatcttggaaacctctgtctatgtactcttttaatctcttaactatatctacatactctttaaatctctgaaactctgtatacatactctttgaatctctctaataaacgattatacaaactagactagttatttttttgggtactcttatttgggttttgattaaaaaaggtgaaatattataatggctattaaatttgttaatacaaagacatttcaaaaaacacaaaagttgtacataaagtggtacataaagtggtacacaaggcatgcaaaatggatacaaaactagaaattaaaggaattatataaattagaattagaattagaaactaaaacccaaaccactacaacccaagccactgcataaactaatacgttttgtaaaccaaagagtcaatctctggattcggtggtggcccaaacttgggcggtttagatggatcgtggctgcgatggtagtagcccgccagagccttgcccattgctctacactcggcatcgctcatgtcgtaggcatcttgcgctctgtgtgttggcattccattgtcctggtagtagtttagaatttgctgccaacgcttggccaatttgagactcactccgagcggtagttcaaagcccttgggtagctctacatgatcgaaattctcctcggcaaagtctcgaaactcgggcgctgcaacctctagcggcttgggtagtttggtcactttgcgacgtctgatgccggtgactggatcgattatgaacggcggtagaccatcaccatcaccatcattggattgtgcagacagatcgcgccttttgcgagagttggattttgattttatagcttcaaagtctgcatcgtcctcatcgagcagctcaaggaaatcggcagctccatcgtactctaccacacctccgggtggattgtatgtaggaacaaacggtggcgtagaaggtggcgtcggtatacgaggaggcggtggtgtagaaggtggtgtcggtgtacgaggaggcggtggcgtagaaggtggcgtcggtgtaggaggtggcgtcggtgtacgaggaggtggttgtgttggctgtagtgtggaatctccattagagtcgggctccttactcaaatcaatatacgttacttcaatgggtttcggtggtggcagtaggctatagtctagctttgtagtgtccacattctctggtgttggttgtgtaatttcaattaccttgattggatattcggtattggactcggaatcagatttatcatcaatattggaatcggtcgtgtctttggttttgttattggatttgtctttagattgatctttggatgtgtcagtggatttgttattggatttgcctttggattggtctttggatttgtcattagatttagtgtaattagtagtagagctagagtcaatattagatccagatgtattggaagcaggggtaatatcagttttagaaatagaggcaatgttagaactagatggataagaaatagaggcaacatcagtattcgaaatagtggaactcttagtattagtaacagagggaatctcaatattcgaaacagagtcaatattagcatcagaaggtataataatgcttgcaatcttggagttggaatcatcatctactttagattgctctttacctcctaaactaccttctaaactaccacctacactgcctcccaaactacctcctcctacgccaccaacactaccacccaaactacctcctcctacaccaccaacactgcctcctaagctaccaccaacactgtctcccaaaccacctctcgcatcgctaccgtcacgaatgactacactcttgatgccactatccgtaccgccgttctgtccacgcaacatgtttagaatgctgaatctagcatcgtcctcggcatccttgtccgagggtttagtcgctttggtgttgtccaccttttcgccctcctttacgtccaacactgcgtagccctgtgccagtaggtagttgcacgcatccaaaatggtgaacctcttctcgtccgattgcagagcgtccacgtcgaacgtaagcttgagcacattgtgggccgtattgcgatacagctcaatcagctgcatcttggtcaacgacaggcacacatacttgaacttgtcctggttcgagtgcagtttgacggcacgcgtggtggtcggcggacacttgtgctgcacatcggtcagggcgtacatctggccacctttggccacaattatccaattgaacggttgcaccagaattagacgatcgcagtagtcgtcggtggatttgtcgtaaatctcaaagaaggatgcgttaaactttgtagagtcggtggcctcatcggtgagtgagcccatagtcttgccgagatttgatgtttttaacaaactgaacgtatagactattgcaattatcgcaatacctaatactataaacacttggtacttgtcaaagtatttaccgatagtaccgatcattatgaaacgttttgccaacgatgaaaagtccaacgatgacaagggcaataacaacaacaagaggcccagattcaaaatgtactcttctcttgtctatgaacctacgcctacagtgattttacaagagtcccaaatagactacgatcacaactacaatagcgcatactgccaagatattgccagaaatcagacaaggttcctccagtgcaatcgggccgaggagactgactctttttcggttcgcctgtacgattgcctaaacggtgaggtggtccgagtgcgcaacgatgccctccggctggacacgttgcgtgactactttgaagagtctggccacactctggccataccaatgagccacaattatcagtttaagatttgcttcgatctagatttgaagccctcggacgatgacggtatcgaagagattcccattacccagctgacgatgatgtaccgagactttacacgagtcttggacgctagctttcccggactcggtatatgtgagcgtaacggcttcgtaatgaccagaaaccgaaacgttcacatttactacaatgtggatgtcagcatcatactctacgataccatgattgatgtgctaaactgtcaactgccaccaatgtacacggacgtgtacaagattgacaagattgacaaggtgccgttaccgtactcggcaaagagcgacggcaacgtttacacgatgcgcataccaccgggttgcagcgacaacgagcacttggccgcagctaaacccaaacccaagtctaaatctaaaagagctgctagtgatactgctactactactacctctactacttttactactaatattaaaaataatatgcaaaataataataatgataacaataatgctactgttattgatgttaatactactagtgctgctactgctgctactaccaacaatgttactaccaacaattctactaccactcttattgatgtaaatctcaatgttttaccaattgttcctaataatcctaatacttgtaaccattctacaaatacgcctactgtttgtacaaccgcaactaaccacaacgacaacactgttctaacaacaccggcaggcactttgaatgccaactctacatcaacctcttcttgcatgtacatttcctttggcaagagtgaatacttttacgactactcttggtatcagcaacgcaccacgatgggtgccaacagtcgaccgctgctcgagtacgaggccaaaccgatgaagattaccgtaacgctcaagtctatagacaagcacaattacgtgtacctggtgctgcccgatgtgggcaacaacaagattatccaagtccggcaacatcccaccttgttggacaccatttgtcggctaaagctggaatcgatcaagagcgtacagtccacgtaccagttgttggatttcgtggtgactatgcgcaacgagttgcgtctaaagaatagcgtaactctgctcgatacggacacggtggacgaacgcttcagaccgatacagcaatcgctggtctcgctcaatcgctacctggccgagagtttgtactttgcgcagtgtgatgatcccaatgcagagaacgtggcctacctaatcagtgctctgattgaaaacgaagagtactcggtgtacctgttgatcgtggccatcatgtactgttgcaacgacagcatgtcctccgaggacgacgagaccatcaagaatgatgtactcgactatttgagcacgttcctctcccgagacggtcacaccgagtctctgattgaaatcatcaagagcatgcgccgatacaagattatgaacgaactctccagatcgtttgcattgacctacaacgatctgctagactatataatcttggagatttccataaagcaaaagaacactatgcaagagtacgtatcggccgtgatgaaccatgtctttagtctgggcgccgtagagggtcccagtgtggaggcctttgaggtaatcataaagctaatttgttttcccataaagatggatttcggagaagactgctacatttacaattacaccaacaaggcctacgaacaagtgacccagctgaaacagtgcaatacggtgcgtctgattcagtcgttgctgggcatcggtgacaccatgtccaagggagaaaaggacattgcgtgcaccaccatcattgccaatctaaagaaccgacagatgcgcttcaacgagtacacctactttatcaacactagtcacggagtcttttacacaatcactggaacctatctacccaagactccgtttctctactttaacatggagaagcgcttctgtgcccacactctgagcggatccaaagatttaaacattatgaactttcaattgctaaagacgtacgatgactactatcgtctgttggatacctttctaaagaatcaacgtctcttgttctacctgactcggatgctgcccggtttgctaaccatggagtatagcatctactcgcaccatctagccgaacgggcatggttgaccatctttcatttcatggagggtgactctatgcgcaacgagcgttgctactttttcgtgcacccactgttggccaaactaaagggtcacaccatggcattggctcgtatgatctcggccctgttggaggcctacgacactgagctctcgtacgacacggtcaaagagtgctacgaacgcttgtcgtttgacaccaacaccgacattaccgaagagcccatcatcgtggcgaatgcttgcattctactgacgttgatgggttcgatcatggacgatcccataccggtacagtccgatgccgaactgggtcaggttcacgaaaacgcacgagtcttgtgcttttccctattgcatccggaacgatcagtcttgtttgcggccaatggtaacgttgtaggtttcgaacagtctggcaagggtatcggcatcatcaagggcaatgttagtctggtagagttgcacgatctcgacatgactggttttggagaaatggaggactatgagggattggatgaggatggggatgagaataatgatgatgatgccaatataaacaattttcaatctaaaaataaaagtaatataaatattaacaataataacaataataatactagtcttggtagtcctaaaccccccagtagaggcaactctccatctaaaagtttcaattccaatccaaacactggtgccagtcccagctctagtagaaacaattctcagagtaaatgcgtaaccgattgtagtcaaaccattgtagattcggacgatgccaccttcaactttatcaacatgggccgtcaggatgaggttgatcgtttgatgcaaatatacactaatctcaccgaagacgatgctcactttaagaacaaactaaacctatgggatcgtgtatggtcgtacgtgtttcgtcactgtcgacccgaattcaaacactacaaagagctctttgttttcctctcggaaacgttcaagtacaacgagcacgttttgagagactactttatgtacacgtgctgtctataccagccgtgcaaggtgcaaaaacatatgaatatttactacggcagtcccaggtgtggtaaaactacactgctcaacttgcacactgaaatgtgcaacgacgatgcaatctatcgaacctccaaagagtacaaggatgtaaagtcatccggtccctcgcccaatgccatacacttgaagaccaagtacatttccatcatcaacgaactgagctcgatcagtaacaatctgctcaaaacgatgacgggcgacgatggcaccaacgatgaccgtaccctgttttcgaccaagtttcccatgttgagcagttgcacctttctggtggcagcgtgcaatcacttgccgtacatgaccatgcccgatgaggctatccgagatcgaatcattatattcctgtttgagatgaaggccaccgatgtggtcaaggatcccaattgtatgctaacctttgccgaaaactatacgtacaaggagcaaatggaagtgtccaagatggcaccgctcctctccaatctgctgtacgtctactttagacagcatcgcaacgactatggtatagtttcgccaaagtgcatcaaccgagtctctaccaaactgttgtacgagtttatgttgaaaaacaactatctgtacaaggtgttggacatgtgcaacattaaagtgatttcaccgtctcagtccaatgtggccatgtcgtccacctcggtgcccagcatcaacgaagaggacctcatggccaatgtcagtctcaagctgattgagtacaactcggcctacaacaagactatatcgctatccaagtacatgtccgagtttaggatgcagtttaaacagttttacaatgaacacttgaagcgctacattggtataggtttcgaagacgaagagggttcgtgctatggcataggcggcaccggtcactatacaaacaacgccaacaatagcaacaagagcgcttcgtacaaaaaggacgacgacacttggagtgatttaaaatccatatttcagattgagtacagacagggcggccgtataaatgtgcgcagattaaagcacgaaattggcaagcactgttcgattacgatgagtgaaaagattgtcgattacataagtgacctgaaacaacagcacgagtacgatcccaaaacaaatgaattggtaaatgtatttatcaaatttaccaatgatgaatctggagagtcggcgttttagtttaagtttgatttgtagtctttaagctttgtaatcttggtattccttttcatcaattgtcatttattgttttcctagcacccaataccaaattgtgttcattctattgttactaattgtactcgtattaaagactgaaataaaaataaaaatcaacctacatacatacatacacatacacacatggccttttgttttgagagaaaagttttactaccaaggatattatgtgtgcatatgtgctatattattatatatgttaaccttgactcttgtaggtactttataaactagcatttttctagaatttttgtacttgcttagcatttaattttgcatttggtgtggacttttttatagctataattttatatagccttatacaggtttgtacagttttatatagttttatacagtctcatgcagacattccaagttttaataaaactaaaaatgataaacttggaattgttaaagttttcgagagaaggatgatgatgtaggtatactagttttaggctttagttgtatttctgttttttgtttgtgtgtttgttttttgtatttctgttttttgtgttttgtagttttaataatagtaggcagtagtagtagtagtatccgcaacaaccagtagtagtggtaggagtagtttaacgctgcagtattatacagtaccggtcatcacacagagtgccaactggagcacaaatgaaattatatggattatggaattgtttgtagagttaaactaaagtgggtggtttggggtattgtattttatttttgttatttagttttattaattgaagaaacaattatataatacatatacaataggtttaaaaaatacaaaaagttgaacagtataactccaactgaatgaaactaaaacttgatatttattctatacaaatacacggctacaggcagactattatactacatcagactaggtgcaccgttaggctcctacaatgtatttccacatgcataattcatcaaacgccaattactgaaattactaaaaattactagtgcaattatagactactccgcctcctcttcaaattatacaattgctttaatacaacaacaatttaccatcatcataattcaaggtaacgtgatcgttggccagcagaccgtttccgtacaatcctccggtggatcccattaatcccggaccattaacacccgaaacggtgcctataattttcaacgaagagtgcagtgtttgcacattcttggtgccgaatcccgagtgcgtgataaagcttcgcacctcagagtgattcggtccattttccaaaaagtgggtaactgcatgatcggccaatataaacagtttgtgcagtatagaggtttgcttctttttggtgagacgatccttaaactcgatatcgtccatttggcacgtacccgtgtagctgcccagggtgccgataaacttgctctctgcgattggtgcgtcgtcgacctttccaccaaacaggcgctgtatgcgttcctcgcacgcagagttgtcgtacagtgcgtcctcttgctgattgtaaatcttgctcggtttgcttacttttagtggaatctttttcagaatatcatcgaccgtggtcgacgagatgtcgctctgatcaaacttggaatcgaataatagagtcgtgttactctccgatgccaaatagtcttgcagcatagtatcggacacgtatagcgcagcgctgttatccatgcgataaactagaattgccgcttcggccatcaaaagcggaccgtgtacgatgcatcggtaaaagttgctcattagaattttattgtacgaaagtataccgcacactaaatgtgtcaatatatgagaatgcgttgccttgttgcatagatcaaagccctcttctcgaatgtagcctatgacatcggtcagacacgaattgatgtattcaatcagatagtcgacgggattgtttgatgttacaatttggtacttgttgaagcctacataaaagtacgtgcacgactgcggttcgactcgtggctcgttcacttccaaatatgtgtttaaatccttgagttggtgtcgctttcgttttctagacaatgcgaccgccatcgtgtattcatcaataatgtgcacttttagacactttcaatacgctattgtagctgcattgcataaacagagttgattaaataaatgcaagacttttaataaaattcttacacagtgatgtacaacagtgttctgaatttcagtttgttcacgaccaagggtgctgacggtcgcgccccgcaacaatagtaccggaccgttactaatgtaccggtcatagtgctgctttgatcaagttggccacttgtttgattaccaagttttagacacgcgcgcgccttcaatacactagtagcaaccgttcggcgcgcgtgtgctctttgtaatctgcaactgatcacatcctggacttgttattgttagtattagtagtgcatcctgtgtgactaaaaaatacctaacattgccgcgctttaaaagtgccagcggtcgcctgtgggaatcagttcacagagagccttacgccgagactgaaggggtttccttttacccctctctcttgaattaattactataccgtagcagttgcttttgttgttattagtacaagttttttctcaagttttctccaagtttttccaagtttattacactctcagaggatggactctggtgccaaaactttaaattccgacgacgagtgcagtactggtagcactagtagtagtaatgtgcaccgaatcaatctggacagcaaacgcattccgtcgtattacaagtttaaaacttttggctcgtgcgacgacaatcaagtccagtgtatagacgttgtgtgtaccgaatgcaatcagacggcgaccgagtgccatactccgataatatcaatgtcgacgcctgcgatgaacactgtcggtgccgaaacggaggaggaggagactcgggtgccaccgccggagcttacatcgtcggtggcggcgtctgctgtcgactggctaaagaggactactactcgcaaggaatggatcgcacgcagagaggtatcgtcgctgtttatcaaatcaatcgtggcatcgctcattgcgattctggtgctgtttaccatcgtcgtgctaatgactcggatactcttgatggattcgttcgagtacgagttgaagtttaaagatgtcgattctagttttattgcaaacaattatcgcaacggtggcgtagtgcacactggatccgaaactggtacttttgcaggtttggactctactgctactagttttaacaatagttttaatttcagtttaaataatcctaataataataataacaatagtgccacactaaatcataaccatactttcaacgctaccaatcataacaatgcatcctatctagagctactgtacgcaaacggttccaattttatggatagaaattttatggacagaatgatgcctagttttattgatagattgtctagaaagccggataccggttccagtttcagcgaggccaactttaaaaagctacaccgacgtcttagtagattgttgcagacctatacaaaagtaacactaaacttgatcatggatgatattcaaaagagtatgcattcgagtttaggtggaaatttaaatggtatgggagggttaaacagtatgagtagtttgaatgcaaactctagcagcgtcaaacaacccagtgaacatgcaatctttagacgatacaggcgtagtttgaaagatgatgttgatggggaggctactgttgatagtgctaccaatgttaatagtactactaggaacaacatcaacaatacgagcaactccaacactagaaatactaggagcaatagaggccgatcagatgccaaacgtttgattcaacaaaacgatttcagtaggcgtagcgaaaagtttcagttgaacgttagagatcaggaaacgtatagttttgacggtcaacgcagagttgctgtaaataatactaggactgttgcaacttcaaactttaagagactcaataccttaccactttctggcaacgctagaccaatctacactagaccaattataaactttaaatccaaagttgacactattccaaaagtcaatggtaatctacccaatactaaaactgacattaaacagactaatacatccactggtaaggcacatgctaaatctaccattataactgtccaagttggtacaaacactaaaaatacggacaataaaacgattaatgattccaaactggatggattaaattcaaactttggcaagcgtattaatactgctactactaatactaccaaatctataggtagtaaaattactagcaccactgcatctataatgaaacaaaagacgactacattattaaagaataggattcagactacagtaaagcctaaattttacaccaccttgaagagagctaaaactactgtaaaacccaggccgacgatgcctactctgaaacctactctgaaaactacagtcaaacctactcttagaactacaatcaagtatactcttaaaactacaatcaaccccactattaggacaactctcaagtatacactcaaacctacgatcaagcctacgcttaaacctactattagatctactcttaaaacatctcttcataaggctacaaccaagcatgtaactagacctacaatcagacctgtaactaaacctacaatcagacctacaactaagcctacaaccaaacctcccaaacatacaactaatcctcccaaacctactacgacactgaaacccaagcctactctcggtaaacatacactaccaacactgaagccgttgcctactcttaaaccattccctaccataaaaccattgcctactatcagacctactataaaaccattacccaccttgcctacactgaagcctttgaagccattgctagagatattaccaactctgggtccattgttgacgctgctaaataaacatacaacaattaaacatacaacacctaaacacacaacaattaaacatacaaccagtactagcaccatacctacaaccaaacctaccacaactaagcatcccacaactaaacctcctacaacaaccaaacctacacttgcaactacaacacggctacttacacaacctcttacaccgcctctcacacaaccaccgaccacaataaatctcacaacctttaaactcagtcctacaactttaaagccaattccattatccactctgcttgaggatttatccattatttgtaaacctacttgcagctctaaatttagtactttacatactactctacatactacgttgcctactactctacatactacgctgcatactactttaactcctactaccactttacataatcatcatgcaactacaaaaacaaccaaaacaacaccaacaacaaccacacctctaactacaacacctctaactacagcaccttttaaacagtttactacactcggaagtagcaccctaaaagcaatttcaaacggcacactaaaggcactctccacactaaaagtgctcgtacaatcaacaagtgttggcactgttcaaacaagcactgtaacagattttacaactgaatcaaaggctgccacagagcctgaatcggtcactagagtcacacccaaatctgttgctattcaccaacatgttaccatcccaaatgcagtcaccaaaggcaccactcttgaatctataaatgtgtccaataccgagtctaaatctactacaaaaataccccttcaaattatagagccattttcacgtcgcacaccaaatgtgacaatattgaaaacaatcctccctccagaggttgcacggagccactcaaacgttacactattgagtccagtaaatgatacttttaattttgacgatgcttttcattttgacaactctataaaccatcctccaactttgagctccattttaaattttacacttttacaacccgtaattttgaatccaataaatggttccataaaaactatagacgagatgaacctctcgagaaatgataaaactttaccaactctacccactccagtgatacctatatccactagtacaaaggccagtgtaataatggttattcccaaaaagacgaccactgagaatcctctgaccaccaagtcggccaatggaatacttgtaaagtttgaaccgctaccgctggagccaatagttactagacgcaactttgtaatggatactattccaactgtgaaaattcctacaactaaaatgatcaaaaaggtgccgggtcgtttgtacggtggtggtccatctaaacgttttcgctccaaaacaaagtctaccactagtagtagtagtggtggtaataaacgcagacctaataggcactaatggtaggttgtatgtatgaagccaataaatgtttggaatttttaaaagtactttggagcactttaaaaaggtaatcattagtgtagttaaagccacttgtattttacagcattttaaatgtagcgtgtaaatgtttagaataaaatttaatgcactataataatgttcaacatcaatatcagcacacggaatctcaatgtataaatgtttaattaaatgtttagcttgtatgtactaaaagtcagaattaatctatagttgataataaataataaatggccaacattttgtgtccaagatttccaagcctgtctagtgttataactgtctactttaatgtttactgtttactgtctagaatgtttagctttgtattaaagatgtttagtttaatatttaagttgtttaatatttaatgtttaatatttaatatttaagatgtttagcacacaagaagtttagcacacaagatgtttaccatccaagatgtttaagatggttattatttaggattatttaagattatttaagatggttaatgttcaagatgatgtttagtattatggatagtgttttaatatttaacatggttactatgattactatttaagaggattaacattaaagatggtttttaaagatgttttaaactgcacttacattcttgtacaaccactttcaacttttatatgctctataactttactgtatgacattattttgtattatattgcattacatattttgctttaataaatggttacaatttacaatgtctcgtcttttatttagactgtctctggtgtaggtttgttggttaccctaatattatttagtgtaggtaggtgggtttggtagttggcccaatattatttagtgtaggtaggtttggtagagtacaacttgatggataaaggtgatgaaaaaagtatagactctgtttgactaaaaaacaacatttattagagtatgatataaagatgtaataggaatacattagagtaatacattagagtaacacacctataacaacacatctatcatatatatctaaacagccagaaccatgggaatcttcgggtatggatcgtaaccttttattataaaatcttcgtacttaaaactgtcaatattttcaactttacgagcaaactccagcttgggaaaaggtctcggctcccgttcgagttgcacctttaatggctcgatgtgatttaaatacacgtgagcgtcgccaatggtgtgtacgaactcgtgcgctttcaggccggtaatgtgagcaatcatgtgcgtcaacatagaatagcttgcaatgttaaagggtacaccgaggcccatgtcggcactcctctgatacattaagcatgacaatttgccatcgtacgagtaaaactgagccaaacagtgacacggtggtagtgccatttggtgcaaatctgcaggattccatgaacacattacgatcctcctgtctgttggattggtcttgagagtgtcaatgattgtctgcaattgatcaacaccctgacccgaatagtctgtctcgcagtctacatacttggtgcccgagtgtctccactggaatccgtacacgggtcccagatcgccctcttgtctgtcggtgaagccgagcgaatccaaaacgcttcgactactgttgccgctccaaatgtgtacaccctttcggctcagctctttggcattggtcgatccggaaatcatccacaagagctcctcgatgacgcccttgacaaagacagtcttggtcgtcaacagaggcagactattgtccctcaacgagtaccgatgcatcactccaaagtgagacagggtgcccactttggtgcgatccatgcggcgattaccagtttcaatgatacttctgatcgtgttcaagtattggtgctcttcccagtttgtctgcattgtagtaagtatctatctcttttttagagttgttaattaatttttacaactacgagttgtaaatttattttccacttgaacgctaagctgtctactttgtagtgcaacgttgtacctgtgtgtatgtgcactaaaagaaattcttacttcaacttgtaaattttaaatctacttaaagtacctctactgcaaccagaatgcaactaaatgcaaatggacaaggcaatttatttatatagtgttccacctataataataccacaaatgataacactaatagcatatatatctacaaaaaaaattgaatttatttacaaaaagcatacatgtattttatttcatttcatgttattattacattttattatttactactacacttgattggaatctacacctaccgcttattcatctgcaacgacactagacgatcgagccattcctcttctgtcggtttggatcgtttgatgcaaggcttgtcggcgatgggggtgctgaatgatccagtgccagcactggtaccctctccagtaccagtactactgctactaccattattggcatcatcatcatcattgccattgttggcattcgacatttccaacaaattaaactcggcatcgaaatcgtcatcgtcacccgttagcagtgaaaacatcctagatgtgattttgtacaatcgttcaaacgaatcgactccgctgtcgactcttgcatgatcaaacacgggcaactccaacacgttggccataaagatgtacgcatggtattgagacgctacgtacttgggaacgagccccttgtagacgtcgcctccggcaccgcgagccaccatcatccggcagactctttcaaagtcggaattgaccacaatcaacacattgtggttttgggccttgataaactctagtaccggctccatttgatgcatgcgtatatagtttacgcagaggcagtgcggcgacagcttttcatacatagagtcctcgcacgacatgagccagtagactagttgaaatgtcaaattggatagaatcgatcggtcaatgatgcatcgtttcatctttttgtagtttagagcctgtttgagcgcatactgaaacgcagtggtcgaattgaaattgtagtctttgcactcgagctcgctgttgatcttgtaagcgcaggcggaatagtctttagttagacgatttataacggtactctttcccgagcaagacattccatcaatacataaattgtaaaagtgtctattgttaattattctctcgacgaggtactgttcgctgttggtcaagtctacgttgggaatgctcagagtcggatatttttccagtaatctatgggacagcgcatcgtcgactacgcctcgcttgcccagttgagagttcaatagtctcagcatgttgcgtttgtattgtaacaaccattaactggtaaagtcggcttgggtttatcacacataccctattagttataaaacatcggcaacttcataaagttgtacagtttgatacacaccgctgtgcggtatagtacttgttcacagtgataataccagataataccaggcaataaaagccactagtagcacctgagagcatcatttgaggtctagttttatttgtagacacatcatgcctctagtactccgcaaccagtattggttcaatagcaaagagttggccgacgcgtttggctctctgcgtataaagggactcggtccgaatcatcgcatgtcgatcggtcacaatgaattcattagctaccaggggttgacgcgactactcaagcgtaaaatcaaacagagggattacactataaagaaattgatggaggccgtactcgccatggagaaggcatacatcaaagacggctcgggagtcgcgaatcaaggctcgaccgagatgggtgccgctaacaagtccgagtgcacaactcagacggacgccgttgtccgtgtcgatcagtgcacacaaaccgaagacttggacgcgctcgaagtgtttggtttcgatgccaccgaagagtgcaaggatgtcgatttggacaagattaacgtggacgattgcatagagccgtgcctgaatctggcccaagacatggaagatttgttcgagtacattaacgcagaggttcaatccgagtctacgtttatggactcgccaaagagtctatcaccggcgtttacgattgacgacgatgactttatgcaaccatgcagtggcaatgtcaatctaaacactataattgaacacttggacgaaatggagggctctttggtggagggtgtcagaatggaggaatctctagagggcccgttagagtctatcaaggaggcctgtgttgacaatgttgtagaggtagaggctaatgttggtagtagtagtagtagcagtagcaatagcaatagcaatagcagtagtggcaccagtagagtagatttcaaagtagatgccaacactgagcctacaacagaagcagattccgattccaaactgaatgtagagatggacgacgagccacagggaccgtttaccagactgaggaagaacagacgcatccgatacagacccaccaaacagactgtgcccggacgattcaagagcgaagatcgctaccttgtagtgtaccgcaagggtagatgtggcaaaactctgggctgcataatgggcaagggtttctatgtgtacaacaagctgaatcaaatgaagggcaatattgagatggccgtacacactcggttggacaagagcttcaagtttgtgtggaacaacattatgaaagagtacagtagacatgtgaatcgtacggccaatgttgtcaagaatttgatcaagttcaagtctacaccggaggttgacgatttcataaactttgtcaagataaagctggagcagatgggtgttaaacattaggtggttgtggtgctcggattttgaactcgttaaatgttggaccatgtagacattagtagatattagtgaatattagtggattcagtttagtttcaaagtggttgttaaacactagatttgatggttgtattttgcaatataggggatagtttagtatgtgtgtggggtggtggtagtttgtagcagtttgtagtgttgtatattgcagtgtattgtagtgtattgtagggtaatatattgaagtgtagtaaattgaagcattgtaaattgaagcatagtaaattgaaacatagtaaaattggtgtaatataattgtacaatataggtgtagagtgcacgtgtacaatatgtacaatataaatgtttaatatggtggattaatatagtgtacaatataaatgtttaatatagtgtacaatatagtttaatgttggtatctaatactacaagttgtaatactataaagttgtgagataatttaaacttgatgttcaagtttaatgttcaagtaaatggctgtaaactaagagttacactaaatgtatccatagtactactaaatgtatgtaatgttgaatatcttcatagtaagtaatactaaatgtatttaaaacaagaataaatgtgtttatgatattttttaataaatgtacattttgaatattgtagagtcaaagactgatgtgctttatacataggtctgctataaaggatataaatattacttgatgttaatgttacttgatgtttgatattttttgaataggttgtagtttatgctgaataaagtctattctagtttaaaagaagtgtactcgtttctgttgaatccaaatctaaccaaggctctacagcccatcttaaacactaccaatctccaaacattttacatgacactcaaacactgataccttccattataaacaactccccatcacaaacaactctccatcacaaacaaccaatacaaacctaccaacacggccactctttctaccctcaatcttctaacccagtaaccttgtacaaagtgtaaactgaattacattcaatacacactaccactactactactacaactactacaacaacaaactaaatctctagcatgtaaacaaaatcacaactcaagtgcaagagcctcagtccaagtgtaaaagctgagcgtataataaatgcaaacaaagccaattaaccaagtgtgcagtgcactcgtaaaactataagccttcttataaaggtgcacttgtaaaggtataaaattacaagactacgtaaaatcataaagaacaagtgtaaacatacaattcagtgtaatttattcaatctaaaaaacagcttacaacttacagcctgtataaagccaaggtgttttttattggaaaaagccgagtttctaaaagatgtttacattcaactagaagtaggtattaaattgaaatggagaattcaccgttagatattgacattagaaagccctcggatctagctacaatatgtatagacaggaagtgtttatgtaggtaggccttttgattgacaccaagtctagacacggcgtttctaatacaatgagagtttaacattgtaccatactaaaaaacatgaatcatggattacaaagtgtactacatgtttacatgctaatgcattcaaattaccaatactggcaattgcttcaattacttgtttattgcctgctaatggtaaatttactaattgaactaatcaagcaaatggtcaaatgtaatgaaatctctctctaaatctaacgagtctaatggattctggaaatgcaaaagtcctctacctatggctaattagtctgtaaatctatttgattaattctcagagccagaggttagagtccaagggatccggttgtttaggatgggatgcttggatgcaaaaaagtagactagttggattctaaaaaaacaagagagaatttatggatagatttttattggtttattatttgtttaatatttatttatcatttatttattagttgtttatacaagtacaaagagttgtagagaatctttacatgctagtacactacattacagtacagtacactacactacactacactacactacatcacctaccaacaaacaatcacctacactcgtttctgtaacattttaacaaactcgaatcgactacgattgtttttgaatcggagtactctgttcttgatcaagactccatcgctcaactccaccaattgattccacaaacctatgggatcacacaccttggccgatgcaaagagtttcccattgttgatgcgtttgagtttgtagcgcttgcatcgattcttgtccaccacttcgaacaagactccgttcggctcaaccagatggaatcgtacaaagtgtgccgagtcatcttgtcgtagcgcgaatcgtttcacgccatcggtaaagctcacgtccatgagcggacgtaatctttcctgtttaacatcaccgcacaacacgtacggcactcgttgaccggtctcggcatcggtgtacgtgcacatgtcgatcggttcaaacttgtaaattgaatcatggccctcggatgcaaaacagtcgatgcgttttatgagcgagaccacatagtcttgcatcgcactctggtcacccttgaatgactctaaatcgatcaggtaaaagagatgcggccatctggcgtgcagagccacatatgcaaagtattgaatcggcatatagtgccaccactgggatcgttccacatcgcaaccttcttcacgggctcgcaatcgttgtgcggctcgtttgaaatccgagtccaccaatataatgttgaacgacaacatggccatggattcgataacgtccgagtccaggtagtcggtgtatttaaacatgtgtttctcatcaatcgtaccctcccgttcggctcgtcccagcatgagccaaatcttgttccacatgagcgtgttgaaaggcaaacgatcaaacagagtcaccgagccacccttgtccgcctcgatcattgctttgataaaattgaacacgtacgccatacacgagctgggatgcgagttgcgcgaaatcaatctagagccactgcccggcttgagcatcttgccgtcgagccgggtggcaatggaggatttacctactgcactcatgccatcgatgcatatagatttagtggttactgcactctttttcaacgagtccaagtagactcggttgaaatcgtccaattgagcaacatcgacaacacgagtctggtaagctttgtacaagcgatcctgctcattttcatagtctggattcaacgagtccacaatcggattcagtttggaaggatgaaacgcgacaggcgaccgaacatcgaacaattgaaggatcgagttcattttcattatcgaactcattgttcaaacagagtacaattctacataaaatgtcacatacttatcgccaataacgtaaatgtgttatcaaaaatacgtttattgtatagtgtgcgtgcttgttggttgaaacttttttcataggatgggtatttaaggagggttctgttcgaggtttggtcattcggttgtgaaccttcattttgtaaacatctgccaaaatttggtcgtgtatacaaaaactacctgcctttagcatttataccagatattttaaagttattttaaaatattctgaatcccataccgagagtgtgtatttgcatttatataaaaacactactacctactcgggaaattcaaactaattccatagtggatatttatatataattcagtatcggtgattcagccaaatcaaatcaaatcaaatcagtttatttgctctaaacatgggtgataatacaatgttacacagtatttatgatgttaaaataagcagtatagtccaacatgttttacctataaaggtgtacaaattaaaaaatttcattaaagtcaaattaaaatttagtcccaaataataataataagtaattaatgtcatgttaagaataattatacagtacagattgttataacaaatttaaaatgagtcattcaaatagtcctttacattataataacatttgttcactaaaatattctttaatctttttttaaacaacattatattcaacgtttttagttctgttggtaatatatggtaatagccagtggatattgcatccttgttgtgaagtgtagtgtcacttgctgtttattacatttgagaatacctactgcaaccatgtacaaggacaacaagtacggcaattctggctacaagggtagctacaacgcttacaacactggcagtagcagtggctcttctggctacggtggaagctctggttccggatcgggtgcgttctacaagtcgggcatcactctgaccaatagcaatggcggcaacggatcgagcactggtagcagtggcactgcgttcaagagctatagcagtgcgacaaatggctacagtgccacaccgtctgtgcaacaagttcagcacactgttcagaagcccgcaactaggagtgtagagacgcagacttatacgcgcgactacaccgagaacaagtatcaccacaagatgaacttttggcaccacaagcccagcagcggtggatcttcatggagaaagtagagtttgtagatgtttaaaatttagcgcggtgatggaaactggggtaactcttaacaaactttatagatgaactcttttatattttatacagaaatgttgttataaatgtataccgatggttgtaattagtttttaccaactcttaccaactcattgttgtgatgccaaatgtggtgccaaaagctgtagtacctaactaattaactaatagcaaaactagtaacaaatttgtagtagtgtaacgattttatattagtattgtatgcatagattgtattaacatagattgtattagtatgttttagttttttagaatctcaattagcataatatttttaatggttaaaaaatacaaatctacctaaacatgtctccatctttagactgtactgtatttcaacaattctattcaatgatggcaactatcctgcaagtgtattgctaaaacttttcgtgtaggcacttacttaattttagctctttctacaacaattgtagctcttgcaatctacctacttactttaacaataacaataccaataatgtttagttatttaatcaactttatttttacaaaccaagctaaccaacgattgtgattttttttgaataccataattttacaaacaactttacatgataattttatttacataataaatgtttatgaaactataccaacctctttcaattgatatcccaatacctgttttgtttaaatctcacctgatggacactagtacctaccctacactacaaaatttaactattaactatttctaaaagcactcttcaagtcaaacgcctacccttacattaatggcaacgcaccaactcctacacttttagtgctcgcaactcgcacgtgtacaaagtgccaatactttcacggtggatggtttacgattatggtctgtttacaagctgattatgactttgcgcttgcatgctaataatggttcagtttacaactctatacacgcaacagtctaattatcatagtaatccttggtaacgattgaattcaaaactgccgacgagtcgttggcatctttataggaccctttatctttaatgtaaccaccgcctctgcgagtggtgctaaacggttcgttgcactcatcttcatcgtcatcgtcttcatagtctccatcgtcttccgaattgccagtgttgcagtttacgaccggtgcatcagagtccacgtttgaagtcttgattatcaaacacggatgcatgcactcggtcgtctgtttctgcacctgggaatcgggactggacgtgatcaacgaggccagactaatgtgccgattgagctgatgcgcagtgagtcggtactctttggcgttgcgcgaacgcttcaggttgtaatagtgccaggcaccgtggtcggcaatcactgtgagcaagattagtttatcggcaatgtgcgacggtagagttggcatcccatcggccaaggcgattccattgtttggaatcacatgaatctgtttaatgcgcacattggtgttggccaactcggtagacttgcacgtattcgaaccgatgatgcccttgaagagatcaatgattacgggcttggaaaagaggtgcaccacggtgcgatcctttctagtgtagtgcatgatgggctcgtgatcgtgccactctatgggatagtatgcaatggttgtgagttcgcacagattacagtacatggccagtagaaacttgaaataggactcttcaccgaaccgatcgggctcgagcaacatctcgtttagcatgtccctggtcaggcaggagacaatctttgacttgaccaaagagtctatcgactcgtgagaatcaacgctatactgacgattggcaaacatttttaaaaaattacagtctgtaatgtttgaccggtacacactcttaatacggtattggtgtttagttgtaactgcgtatatatgcttgagggaaatcatttcgatgcaatagcgaggcgtgtgtaatatcgaaacagctcatgaatttcacatttatatttgtcgccgtggtcgtggcgatactagtcaacgggctcatggtactctactaccacagcaaatggtactcgagttccgatgacaagtgcctagacctgggtgcacaattgcaaaagattgaacaagaggtgcagactcaggcaaggatgcacagtgcgaccgacaaagacgaggacatggaaaactattttggctcgaggctggccaactatgtggaatcgtcagagttggcatcgtacgccaacgccgaggaagtgcaccgagagttggcaaagcgcgatagcatccttgccgagctgcaaaagctggtccaagaacacagagagtcgaccaccaacgatgacaacgacgaacacctcaagcagatgcatcgagacgtttccatattgcaacacgccgacattgacattaacaatcgcatgtccaaactacaagtcaaactggacgaactacaatccacggtcacggtagatgtcaatgaaaagatcaagaccgaactgcccaagttgaaacaagagctgcaaacggtgcacgtaaagcttgtggacgcttgtcaggttttggccaatgtactcgagcagaacaacaatctgcaaaagtcgtttaataaactcaaagagtctacggatccgagcattttgggtgatcagttgacgatccgactgcacgagtacattgacaccaatctggaacaggtcaacgtacagactcgatccatacgcgcgctattcgaagagcacaagaaacaattgaccgacagcagcataatggacgacggtgcggtggcgaagcgcatcaagtccctgtccgatgcgctggaccaccaacgcgacgagtacgagggcaaactggcagaggttgcacgctctcgagacgaggttcaggagaaactcaaccggctagactttctaggcaacctgaacaatattagggatttggcagcaaagctagacaccgagatgggtttcaatacgcgcatatccaccatcaacacggcgataaagtctattcagatcaatcacgaaaagtggctaaagcgagactttaaggctgtgggcgatggtgtgacggacgacaccgaagccatcgaggcctttatcacacacttgctcaagaccggagacgtgggcctagtcgaagccggctcttttctaatgtcaaaagctgtggccatcaatagcgacgaagagggtcggccctttaccatcaagggtttgtcggccaatgccagcaaggtgactggacccggaatgctcacgttcagagactgtaaaaacatgaacatagagtcggtgactatggatcgagtcacgatggtgaattgtgacacgtgtcgctttgaaaatgtagccttggacgagttgaccatcagcttcatgtccaatgtgcagctgaacaacattaccgtagactggttcgcactgagcaacgttcagaatgcccgcttggaacactctaccataaagaatctcaaggtggtggaatcacaaaaggtcctactgcgctccatagacgcgtgcaatgtaacctatgaaaactcgaacaattgcacctatgaaaatagccacattatggaggacggtctggtcacggtgcgagactgcaaactggtaatgtttgagaacctcttctttgtgggcaacggctttgatgtgttcgactgcaagtacttgaccatatcgaacgtcacctttgtggtgtcgtccagagagtgcatcttcatgcaaggctgcgagtttagcaagattcaaaactgtacaatgcacgatgccgagtgtgcaatctatctgcaagagtgtgacaacttgcacattaacaacattttggtgtacaatcaaaagattccagccaaggtggtctttcaggtcaacaagtgctcctttatagattgcaaagacttgagcgtaaactcgtccgatcagtttgatccgttgacggtgctcgtggacgtagtggacagcgattcgtcgacctttgcgttttcgcgcatcatcaacgttcgaatcatttcgatccgtcccaattgcgaagacgtgctagtcatcaagcccatacacgaaatcagttcggtggacgagcaccgtctagacgtgatcggagacacaaacgatgtatgctcgtttatgaccatatcaagggtgtacaagtctgattcgtacgaacgcgaagacggcagaaaagtcaccaggggcatgcgactgatagaggccaacgaggaggacactgacgaagcgatcgatccggacaaacccatggtactggagcccatgtaccgcagacggggttcgattgacgacaattcagagcgactcagtgcaggcagaggacgtggaagcggcagactaagtgcagttgctaggatcgatggaatgaagagaaatggtgctggcagaggcggcagtaacggtgagggtgattcaatcggtaaagacgaagagcttgataccgagtagtatgactagatgagattctagtatatgcatacgtgcatgcattgcgtatactccaagttgtacaattgtactacaaaaaagtatactcaaagtgctactgaatcaaaatgtgattatatgcaactgacgaacaaatttagatttaaggcaaccggtgcagctagtaaggatttccttacaaggatttattttataaggaactttaagacttgagaatttatgatattttatacattccttttaagaatataatgttagtttaagatttacgttacagtcttccattgtgtttgaatggttacattacttgtttgaataattgtaatgttattcctagagtattatcaaggtgtgggtttaaatattagtcctagagtattattcctagatacttgggttttgtgcaatttgggggattgtggttaaaaaataaggacatggcaggtaaggttgtgtattactaaggttgtgtattacatcatttgttgtgaaccttggttgtgtgcatgatgataaatttggattattagtagtagtagtagtggtagtagtagatagagtttttgcatgcttttacattttacaaatcatggtggtggtgtattattattgttgtgattagagtacatttataccttagtacatttatacctttatacatttataaatttatacctttatccattttacatttatacattccatatactcattttattttacatgtactttttattttacatgtactttttattttacatgtactcatttttatttaatactagtacatctttttttagactcttaacatgacttcaaagaaagagttcaaggtggaggtcgactctgcacctccatcctataaacctacaactgtgcctacctcctataaaactataactgaacctacacaatataaaaatacaacaacccctacacattacaaacctacacaatatgaacagaatcaggatcgcttgcaatttgtcaaattcagcgacagtcacattagagccatacgttacgcgttcaactttttacaacgtgcaaacgagtctctgcatccgggcactgagcttgatctggctcaactcacagccgaacagttggccgagttgctagtctctcaaaaggacaagtatcgaaacactacaatcgtacagatcgccagaatcgtcaagtccttggatcgggacaagtatcgcaagatactctccatgattattcccaaggtgggatgggtgcgaccaaagcgtacggctctctacaaaaagatggacattgtcacacacaatgccatcgagcgtctggtgctggacgtgaccggtgaaccgtggctgtaccccgaactggccccgtccatcatactgtgcatctgtacaaatttgcgtatgaatgaactgcaacagttgactaggaaatcgctgatggacattgtcgaaggccgcaaggtaaacattaaaatcaagaagcgttctcgcttcatacgagtcttgtacatacgtgacattctattgaaattcctagactttttaacgagccacaccaacgaggactcggaccgaatagtgaccgtcagtcgatccacattgaataaaatgctacgatccgcactgttggagaggggtgcctcaccggatgaactctttggcatacagtcgatacgagtgtttaatacgacccgaatgattgccaatctaccgttgggtctggtggccagattcaatcggcaccggaggatggagactacatcgcacttttacgattctggaaatgtggtgtttgagaaggagtttagagagtttgtgtagaggattcatgtagaaggatttggaaggtttatgtagaaggattggtggaggcgtatgtagaaggattggtggaggtttgtatgcatgtatagagagatttgtatacactagttttaatttttttatttaaaaaataatattatgttataatatatatttaatgtaatttagagtttaaaaaaatgcatcatggtacaatatatgtatatttttttacaatacttgtgaattcttttatttactaatactattcttttatttactaatgctattcttttattcactaatactatcctatagaaacctataaactcctatgtaattataaactattctaaacaactctaaacaattctatacaactctacaaatctagacaagtctaccatcaactccctacaaaactgtagacaaccccaacgcagacagattcaattgctgctgttgattctttccctgcttggctttgataaagggcttaatgttgttcagtacatcaaactctgtattggtcttggcaaactgtacactgcgcgttgacttgctctttttggtaacgtgttcactgcccatttcaagtgtacgcttcaggatgctctttggtagccggttcatagtggccggtggctcgtccattgactgcgagtcggcatccatgattgcggtggcctttgtcgagcccatgattgccgagtctagcttgtctggcggtggctcttgtgccagaccgctcagttcaccgttggactcatcaaagagattaaacgttgaatctggtcgggaatcgtcttcgttcaacgttttgaacaaccactcgttcttactgggagcagtggtcgctttgcgctttcttgaagtctgcttggtcttgtactcttcgatggtgtttaaaatgtccaatttggccaaatcgtttgagccatcggtatcggtgtccgtatctggctctggagagattgatgtaggttctacatttttaggattcatagactcggtggatagaggtgcaccacttgtatcatcctcaaagtctacgtccatagcattagattgtatagcattagattgtagagatgcatccaccggagatgccagctcttttaccgattcttgtagctcttcaacgggtaatgattttggtgatgattccaattctagtgcagtcggtggctctaatcgattctctggtgaatttaatgactttgctgaatctagtgtaattgatgaatctgttggttttgatgaatctaatgagtttaacaaatctattgattttgatgtatccaatccctccaagctaccatcctttacactcgactctgttgcactacctaaaccatcatctgtcctaagaccatcattctctgtcctaagaaaaccatcatctatcctaagattaccattctcagtcctaataaaactatcctcaaaaccctcttttaagccatcctccaaaccaccactgaaaccctcttctacactatcctctactacactcctacgataccgtccaaacctatcgggcaacggttcaaactcagactcgtggtactctacctcgtttgtggaaacgtcatatgaaggatgggaaccagtgttgtcattgtcgagttcaaccactgtaggttcctccatcagtctcagttcttgatcagttttgggtttgagttgatccagattaatgttttcattggtcgtatcgaatgtgacctcactgagcttgtccagtaccgattcgtcaacattcttgaatatagactgattaatcttttccagattcagattgagcatctgaccaaacattttcatagtcacattatagtagatggaatgttttttggtttcacgagtggacaacttttcgatgcgatgctcaatcagagaaatcatatcgtcatcgtccaagtgaggatcaatcttggtgggatccaagacggcatcgatgccgataccaatcttggtcaaaaagttgatcacgccaatggaaccggatcgtactacggacttgcccaccgacaccagtatgctttccagcttgagctgagaggcaaaatcaaagagtcccttgagcgcgtccacatcaatctcggtaccgtagcgtttaacatagtcgcacgctattcggtcgcgctccaaccatgacatgagcgcggcctttttgtacaggttagcattggccagttttatttgattcatcttgacatgacttctaataacatgccgcctcaacgttactatcaatagctcatgtgtaaaatttggacaaaggtaaaactcggttagtttaataatacaccatcaaccttggtatacttgatgtcaaagggtgtcataaagttgcgagtctcgtacagctccaattctagatagttgcaactggtgccgttgctcagaaagtctgaccacttgcacggtaccgttttgaagagatccgtcaccatggacgttagattgaaacacttgaaatgcacggaaatgtccagtttgcgatccgtctgtgtggttcgattcacgcaaggcgtacacgtagacttgttgtcggtggcgtccgaattgtagagcctggtcactttgggatcaccgcaatcgcaatgccaatccacggcaacgcctcgatcgtcgtgatcaaacacgacccgagcatcgctgtgcgcattgggcacctctcgagtgcacggatcgttgatgggatggaatcggtttgcgggatgcggcagcactcggttgttggtggtgttgttgaacttgcacgtgaacctatacgttccggtgccgggcaccaattcgttctcgtcgtccagtgtcacggtggccgcatttactggtgcatttagcaaattgtcccacagtatactgccggtggacggatgcagttcgttgttgcatgcaatcactttggacgcatccgtaccgccaaacaggttgggatactttgatcggcacacccaagagcccagaccgtcggccaccacgtagccggtgcgaggattgcactttacctggttgtcgaccatgcaatacttgccgggtgccagacgcttgttgatgtggtaaaactcttgactgggactcacgaccaccattcggcccagggaaccgcatctcgatgtgcaatagctattgtactgcaacagcgtagtcttgtcctttggatcgagcggtgctacgaacagaggctctgcggcacactgcgacaccttggacaagtcttcgtgttgccgaacataggaagagttgtggtcgatgagcagcgacggtagattctcgagtccctcagagtttatcaatttggctagcttttcatttttggcttgcagattgtacttgttgacataggcatagtatttagagttgtctagacgcaatgtcaaaaaatacaacaaacctaccacaaagagtgttcctacaaagacgggcagcattgtggttgggggttgaggttgagtgttaccgttgggtttgattttatattttgttattttgttattttcttagtttgttattttgttttaaatctagtttaatctatagtttaaaaaataagaattaattaaaccaaagatgtagagagagaatccatttatttagtttccagtttagttcagttatttcagtttatttcaatctattcaatttcattaatattgtcatttattttcattaatattgtcatttatcaatccatctatcattcatctatctttattacacaaatctaacactttaacgattccattatttccagcaacctatcctactaaagaatgtgacttaatctaacatgtactgctaatccaaattaccaaactagactatcctaaacgatactatcctaaactatcctaaactatactaaattatactataccaaactaaaacaaactaccctaacacgacctcaacttaatctaaacacctcaactgatcatattacacattacctcttgatgtattaaatattaaacatttgatgtacaacttgcatttcaacacaacacttgatgtataccatacactcttacgcatcacatagagagcactcggtagatgtaggcagcttcaatttatgtggatgaaaccaacgaaacacagtccttaatcttgccagcagtcagcaccgtccacaatgaggccagtaccgtgaccacttccagcacgatcgatacaatcatcatggtcttaatcttcttctttttcttttccaattcatcggctgtgcttgacgtactcgaagccttaacgtcagcgttgtagtacaagtaaactgccaggaagaggatcgagatggcaaccagcaccaccgattgtatgatacccagtgcaaaaaccgtactggccagtcggccacattccggtgtgatgcgagctcggatattgttgattgcgttgttcatggtgtgtgtatgtgtatactttggtcaaccgtgcacctatcataattcacccaaatacaacgctaataacatttacgagcttcgccgcttacaccgtataatatgttgtttttcatttttcgtgtaatcatacaattcaacagctctagcacacgcacaatgtcgcacactcttagacgagcgtcaaacgaaaaattgacaaaaccctctagtaaaagattgcacacttgctgtgtgtcgaccacaatcttggactctttgaccagagcctccaattgatcgacaaagggatcgcgctcattgtttagattgtagcaaaacatggtttctgtgcacgatgcaaatacaaaaatcaatggatacatcgatgagtaatcaatgaatccaccgacacaattggcattattgtttaaaactctaacgagctcgttggccttcttgttgtcaaacgatccatgctcatcgatggtcgtaaatgtgacaaacttcatttttcaaatttattgtgtgcttagggatcccgtacacgagctcattccaagccgtgtatgttggtgtctaaaaaataaagggttgtattttgtaatgtactacaacttgaagtttttataagaatgtaaaactagagttaaatgatgaaactaaaaaatacaacattttttatttgatagaattaaatgtacatataaatgtatttactacactatcctatcctaccacttacactatcctactacatacaaactaaaacacaaactccactaatatgcaaactccacattaatacacaaactatacactaatacgcaaactcttttacatttttcaaatacctaaactctgggttacacaaatcatttgtgattggcaaatctcggtactcggcaacctttccgttgaacagtaattgtaccgaaccacctccattgtataatacatgccccatttcatcattagagtttccatagtcatcactgtcggcatccttcaactgtttaccctttagcattcggctcatggtcagcatgagtgcaaacactgccaccagagtgccaacggtcaggtagaatgtggcatttgaaaactgcgtgtccagagtgtttttgtagagctgagagtacgccaccgcagcaaacattccaacggcattctccatcaccgacagaaaggcataggctacgcctcgctccgaagcaggcagcacctttgaggccatcgatcgcaagagcggagccacacaaggtcccagtgcggccagcgtcgctcccaggtaccataggttggcaatctttgcatgagcgtacaccaagtgtccacagatgtgagccacggcgcccagcattacaatcagtgtgtcggtccatttaaagattcggctcatgattggtataccaaagagcatcgccgtaacgtacattgcactcaggtaggttctaaagtggctataggcagtcgtgtcccatttaaactctttgattgcatacatgtacattacagagcgctcgtctcgatgaaacgtataaaaggccatcgacagcaaaatgaaccacaaaaagagtcgccgattgttgggcctctttttcactagaatattcagggtagtgttgatgttttccaaatcgaaaaagtctccgagtgcattcttgaggccagcctctttgagggatttttgctctggtcgagtttgccattttaggaataggatcgtgtacaatgtggccgcaatcattagactcgtattgatcgcaaacatgatgggataggatcggaatcgcttccacagcacactaccgatcgccacaccggttggcatcgtgctcaggtagacggcatccaagatgcccactcgtagcgtgcgattctccacagtcgacacatcggcaatgtaggcaaagcacgctgcgaatatggccaaatcggctccggtgagtgcactcggaaaggatgccgtgtagattatatactctacgggccagctcttgagactgtttacggttagcattgccgagaaaaagagtttgcctacgagtccacatacgagtacaatctttctaccgcgcctatcactataggatcctaggaaaaaggccaatataaagggcactacatgactggctacaccgttccactgatgaaatgtagacacagtctgctggactcggttgttgatgtcatcgtactggctaatgttgtggcacacctctggcgagtagccatggttgacggtgcacgcttggtacacgtaaaacgcctgctcgatgaccgtggtcgtcatgaaggccatcatgtatagaaacatgggaggctccacggtaagccattgttttttatcacccattgcgattaaaactaacaaaccctactgtaaacaaccgttatctgagcaatgtaatgtcgccataattataatacgctatacgccttgtgtggcattccacaacataaggttgatacagtcgcacgtctgtcaagtcttttgaatttatgtaggcaatttcaaagtttggccgactcgacattagccacgtcataaacgtccagtttgggggttttttcaaatcgtcgaccaagagtgcgatatctctgggtgacgagatggcctcgttcaacataaacaaattctcccaagtaagttttattacgagtttacacgcgtcctcgtacttgatacgaaacatgtacgcgaccatgtgatgcttgtaggcgttgatcgtcattgcatatttaaagtagctaaactgcttcgtgatcgtgtttggtatcaagtattgtacatttttgtattggacatcgattactggcttttcatagagaatcgacgattccatgcatatgggtttgttgtaaatttcagggtcacttggaatcctgctagtttcgatgcataggaaaatgtccatttttcaacactgttttaatctcacttttgatgtaacgatttaacctataaatattgtttcaggaatttgaacagtttattgagagtaagatttttgccagtatgattcaaaaactgactagaacggctcgcatcattacactcaaactgcgacgtaaacgagtcactcccgaggttgaaaaagagtccaagattacgcagcgcaacaatcagtatcaaattatggctcggaatattatttactttctcatctatcagaccacgtacggtactcatcccaaggtggtgattgcatccaaacgcactcactactatggagccaattccgagtacgataccgacatgattatgaacctggacaagtacatgaagcatttcatctctttggtgtacgaaaagtttgccgagcaactgcgcaaatcgtacactgacaaggacaagagtaaggctgagcaacaacaacaacagcaacaacaggctcaggctgagattcagggtcaggttgaaactgatcagattatacaagctcagcctgcgtatatacaaaatcacaagcaagacagtgacgatgaggacgacgatgaggacgacgaagacggctacaattcggatgcgagttgcatcaacgattacgatgcctattctagagtgtgcaatcatgtaaagaaactgttggacaatggagttggaaatgccaatagttgtgtaagtgccagtaacggtaacattgaagattccgagtctcgagatgggtgtatggatgaggatggggaggatagggttgatggggattcggatgaggatatttccaacgtacccaaagagtttaacatacctaaagagtccaaagagcccaaagatgcctctaaagattccaccaaagagtactctaatgacaatgacgattccaattctgttgtaaatgatcacattagtgttggtgctagtgctagtaccagtaccagtgccagtgccagcatcgttgctagcaatggagatgctgaaagtgtatacagcaccggtgggactcgttaccttacaaccgactctaacaaacgtttaaagctaaactctagcatcgaagacgatgacgatgacgaggagttggccggcaactatagtgtgtccggatccgtgtctacactgaaacccatcaatctggccatgtactcggaggccaagtccaagtacaatgagactatacagaatgacaacattatcaaaaagctctacctcagcctcttgatggaattgaatcaatccaaactgttgtcgttcctcttggaaaagattgaaaacaaacgctatgcacagcgggcagtgatggaggttttgcgcgagtctagccgcaaactgtcacgcaaaggagtcgcattcgcacagcgcatccagtacttggactatattgaaaacttgctaaagcaacagtgctacaaggacgtggccgataaattgcacactctggcactcgatctcgagtacaattgtttccggtacacggacgtggtgaatcccaacgacgattgtctgcccatagatttgaagcactttgacactctggccagattcaccaaaaccgtgtacggctacagtactcatacgccgctgaatttgaccaccgagagtcacactctggacggtaagatttacgacattgtaaagtttacccgagacggtgagagtgagattttcgatgtgcgtgcagtgaatcaagtgcagttggacttcaagtcttggaaggatcgtctaaactgtctacccacggatcagttgccgcagagctacataaagattataccgcacaaaatcaacaagattaacatttggtcgggcaagctcaaagaggaggctgacaagacgtacttgtatgtgcgcaccagtggcctgggcagaggcactctgtttatgaacattggtaagagtgccgagaagcgtagaaacaagacattcccggtgctcaacactcgtcacaagaaactgaaaaaggaccacttgtacgatggcgatgtggtagagaccaagatcaacaaggatgccgaaaagattataatggcaccgatggagaactgcaagattgcatccaccgttaaatcggacattgcgtttgacgtgtctcgtttgatgggctcggtgatgactgcggacagtagcatttacagtgaacgaggggaggacgaggaggatgccgagtgagttgttgttttagtattattagtattgattggtattgattagtattagtgttggtattagtattagtgttggttagagtgctagtattaattaagagtaaaagtgttggtgttggtattagtgttagagtcccatgtgtgtgtgctaggttataagatttcaactcttgtttgcattacttgtttgtattactataagatgcctcttttgttcatgtttagttgtaacgactcttttaattacttgtaattgtactgtggttttttagaatagattttacaaatcaaggaaaattgtatacaggatgtggtactaggcactagtatacattgtgtaatgactataattaacaaatggttttatcaacacgccctttggtgtcacatcctgtgtcggtatatataaaccaaaacatttgacgatagtcttcagttgacctacaaaccttgacaagtgtacatctcctgggctgtgctactcctgggctgtgctatatttgatctgtactatacttggactgtactataatgggcgcctgttttgaatagagtgcaagcatcgtgcagctcgacccgttgctctgagaatttagttgctcacaagttgtgttgcagctacaatttcagtaggcgcttggactctagttttttagaatacaaaccattcaaagagcacatgttgctctttcaaatatagacttttattattatcattccatcatattgtacctactttactactttgaattacctctgtgcctaggtaacaatatttctgtcatggtcacttcatttccatttgtgttgtactagtttcagttatgagtttgatttagtttttgatttaattttgaatttaaagtgtataatttaaagtttgcattgactatatagttggagtttagttttatacaaatcaagcatcgtaacacaaaccaccatgacgtacaaccctcaaataccgagccaggaaaagtgctgctaccgagtgctgaccagactgagaccgattcagactacggtattggacaagttgccgactgcgagtgctgcacgctttgagagtgcatccaaaggaggcgccgaatctttccacagtgtagagtttgaaaacaccgtcgttgcggatcccaacagtggtgccgacgatgaagcaatgatgcttagtctgcccacgttcgaagagagcatccaactaaacgaatcggtaaaggatgtcctagaggagcacaagtcaaagtgttcagatttgtacgcgctcaacatggtcaaggttagaaaatgcaccaagaccactcgtgcccgcatcgcatcgtacaagtggcgtcggtacaagattgatgcagtgcagtgtcctacgttttcatggtagcttgtgtgatgattgattgatgaatatatatctcgtgactaaagtctctttgatttgtatacgatttagtattagtattagtattagatacgtaactagtatttaagagcaacctagttgtttaactgccttgcaccttcctactaaatgtaacactttgaaatgctgtaaattttctagttttagtattagtactatagtagtaaatagtatagtagtaataataatatagtagtataatataatagtagtaaaatcaaatactaaaacacacacaactactagtacctaataaactgaacaataaaaaccaagattcaaatacaaagttgttttcattcctgagagtattcaaatgtagaatcttaaaaatccgagagagtaacctaaattcagaatctttaacttgaatgcagtggatattcaaatgtgtatatacttttggattttaacaaagacttgaactgagatttcatacagagattttagaggttagagttggagtttaaagtttagataacaggtagagatttacatgtatttaaatgtacctaccaagtttttgtattttttagactaattcaactcgtaactaattcaactcgtaactaattcaactctataaatcaccaccgagtccgtaccgttagcctccaacatctagttttaccacaattctcaaaatgtcattacataaacatgatcccataaacatgaacccatcagccgagcagtagctagtcaataaattaaaccagacacccagtaaattaagcttttgatcgatacctgccaatgtagatgcataatgaaattgtaattcagtccatgtaaagcaatccaatggattcccagagtctgtattttacaagtcaaatgttgttttccgctaatgaaactgagactttgattttgatttaattatggatgcatccctataaaggaaagagtaggaggatgggtaggaggatgggtaggaagattacaggaggtagagttaaactaaaaaaatataaatcacaacagtttgagtattaaaatctttatttgtacaaactaagtacaaccattacctatattgaatactaaaactacatagaactagaattagaactagcactaaaactagtcaatactttaatctaaaacacattataaagcaccattaatctcaacaacaagtaaccgcaccacctccacctcaaaacacgtataaatcatcaatcctatcaaacaagtcaccgcaacactctacacaatagagattcgacaagttgaacaacgacgacaacggattcggatagcgatactggatatcgcatcgcttacagtagcccgtgtacgagactccttcgacgcccggacacaggtagtagtcgggcggcagagttcgatgaaagagtttggcctttaaatgcttcggaatatggtaggcgcaaatcttttccctcaacgagtccacataatccaagggcgagttggcatcgctcatcgacaccctggcatggtgtacatcgctcaatgcatccaaaatgatcgactccaaagacttggcattgaagcgtttcttgaatatttttgcaatgatcgactttagattctttctgatcggcatgatgaaaaatgtgcataaaccaataaactagcgtcaaagataagcacaatagcgtattgcctttgcagaattcgctatattaatgatggtagcgttgcaagtgtagtgccttttaaatgcaatttcttatcagtgtttgtatataaaagcttagtgacgccgttttgtggtttagtagtcacgatgatgtacgctgacgaggaacactattacaacaacaagatttcggacgagtctataaaatggaccgaccgagtctacgtcctcgattgggcatcgaccaagaatcagatttacgcgttcggtgtagacgagtccggggactcggcaaagctaatgatcaacaacgtcaagacctcgctctttgtgtttgccgagaacgagatgcatctgacgccgttgctcaatctcagacacgttgacctggagcggcccatacgcgagctctcctcgttcaactttgagattcccaacaatactctgctcgatacgttgattcaaacgactagtgttcagtacaagacgtttcaagtgcccacctgtagctttggcgattctcaaaatctacacaaactcttgaacacgaccgctctgaagaatcacatcaagactacggccacttggtccctggagttgttgattgtctttgaaatggcgtgccgtacgagtcaggccagtctggaagagtgctcggtgtacgatgtgtttgtcgacgccaatctggctcgctacgaagacttgcccaagccaaagattgacattgtggcctttgatatcgagactctgtctagctttgattaccgactacccctgggagactataagaatgacattttgttttcagcctcgataaaggatcacggcaccaacacaatgtacagttttgtcaatataccggtgccggtggattttgattacaccactactggtagtggcactgtggccaaacgtgcacgattggaacaaaccgatacggtggatgccaactcggaatcggtacgagcctatacggaacgcctaaagagtttgatggagcgagactttgaagccactcgcaacatgcaacgcaaactggtggtcgtgcacgatgaggtggatctcattcggctcatcctacagacgctggatcgcaagaggctctattttctgttgggctacaatagcaagggttacgatatgacttttctcattaaacgcaccgcctacctgtgtctgcccgagtttaaaaactttaccctgtaccgaggcatgccagtgtacggaaatcacatgattcacattgatttgattaaaatctttcgtcaactctatccggaggtgggtaagctgtcgctggacactatggccaaactgtgtctgggacaggccgagggtaaggtggagtttaacgccatcaacattcgacacgtgtaccgacaactcttggaacgaggcctgcccaatgacgagtgccactttgaaaagtttaacattgacctggccaccattgtgcactacaacgatgtcgataccgagctactgtgtcgactgtgggactcgctcagctacgacgagtttctacccaagctgtgcaagagccatttgatttccattgtacggtacacgcagtgcaagattggagagtttatcaacaacaagtctgtctacagtagtttgaccgatggtaagattttgacactgcacaagagcatcggtggtgggctaatgatcaccaccaacggtagcgtcatgtacacgtacaatcagaatcaagtgtcggcgggagtgaacgaggccagctacggtggaggattcaatatgcgcatcgcccgagaagtgtttaccaattgtaaagtgaacgatgtggtcgcctattatcccaaattgaaacagggtcacaacatttcatatgaaacgatcgcaatcgttccggtgcacgtactgcagcgactcagacccattctgaatccaaaccatccgtgcagatatttcacatttaccgtgcacaagtgttccaaggaagaggtcgtaaatcatgcaaacactcgtaacctgatcaatatgctggagaataattgcgatgaatttagttcattggacgagtgttgtaaaaacttgaattccaacgatcgtgtgctaatattgagcgttgagcgaaaaccgtctctattgggcaacatgattcacaaacaaaacgttttacgatctcgagccaaggatttgaaaaaggaaatggagaccatgttgacccaggtgcagatacgattggatgcggtaaagaatagaggcgacgactatcaagaggttgtgtttgattttgatgacgatgatgacgatgaggaggaggaggacgaggatgaggacgaggatgagaacaaagatgaggataaagaggacgacaaagactctgatactaaaactgaggataaatctaaaactgaaaccaacactgaatctaaatcaaacactgaatccaatactgaatctaaaaccgactctaacactgacgacccctccaaacctgagaatatggaactttgcgatactggctctatattcaacactgccgatgtggacaaaagtagtgatatgaaaatgctagtgcccaagtttaaactgctaacctttgacgaaatcaaccgatgcaacgatgttcaattgttgaccgactatgaggttaaactcaagggtgaactgtctcgaatcaactcgttgtatcgcaacttgaagattgtcaactgtagctactacggcctcttgggttccgactatggagcgctcagcggtagactggtggcggcagcgctcaccactctgggtcgcaagtacattatagacatggccaggtttgctcatgtgcaaaactttaaggcagtactgatcgataccgattcggtgtttgtacacaatggtgactcgaatctggaaaacaatccactgcccgagttttgcaagactctgaatgaggaactcgaactgaccgccaagatgtatcagttcatctttataatggccaaaaaggtctatctggccaagtgcaagggtgaatggatatcgagaggtataaacaagaacggtcccaccatttggaacgatgtcatctttacactggccgagcgctacctgattgagcgcgtaccgatatcctcaaagatgctacaagacattctagtcaacgaggtgtacatgtacattgcagagcgtgcacgcaaagatcgcagcgtagtactgtgcatgatgagcacgaatcgtgaaaaggtggacactgccaacacgcccattgcaaagatgatgcgagccgttgtggaggacgagcccgattacatattcggagagaagcaagtcaaatactttcattacttgaaaaacaaaccgaccgatgtaatctttgaggctgcccatcacttgaacgatgtgcacatttcacagttgaatctgtacaagtttgtgtccaagattaacactaccatctatcagatcctctcaaaggccatctacgatgccaacgtcaaggagcgaggagtgcacgcaaccatcacgatggccgagtacaacatagactcgatggctgcctttttgcgtgtaaatgaaattatgaagggatgggaggattgaggtagtctttgctggggatttagttttatatgagatttgtataaatattaatgttggagtgtttagattttaaataaatgtacctatctaaattgtagttaaataaatatatactaaccaagtaatactttgttctttttttaaacacatctacttcctcagcttttgctccaaaaggctaccggctgctacctaatatctaccattctacccacatcaccagactcattacaggtccaatgactcgtcatttgttcaacgcacggaacgtgtgtttacacttgacctttcaatctcaactttgttgcaacagtacacagcactgtacaatacagtgtgtgcgcgtgctcagatcaacttttcttattcataatacaaacttacaatgctaattaatgttgttgtaaattgttgaattggtcataaaatgctaataaattacacgcctataaataaagtaggtaacggtcgggtaatttacattatacggaaatcgtaaatgttatggtgcccggggaaaggtgtaagcttatctaaacccatcaacggccacttttgttggacattatagtttctggatatttgttatatgggcactttgggtagacttgcaagtaaggttgtttgggtctttgaaatgaaacgtgttggtatactacacacaacatttattcaagcaagtagcaagtaatctaggattggatgggtttacaataagggtactcgtttggaggttataagttaatatacaagtgattggcttgtttagaacctgatataccgtgctctacctctctctctacctctatcaacaaaaacatgtagaatgacgagttggagtttgtgtacttacagttgcttacttacttacttaggcacttacttatttacttacttacttacttacttactctacaagtataggttagcaaataaacattacatcacaagccgtctttatagctttgccaactgcaagtgttacaactatataaaactgtcacaactaatattacaactatcaaaaaacataatctaccaaacttatcaccaacaggtttaattttattccaatacttttaattttattccagtactttgattttattacaatacttttaagtttattctagtacttttaaatgtattccattacttttaattttattccagtacacttaatcctacatagtaacaccaaatccaattcaaagaacagtcaaaacaatcgtgcaaagcaaagctcaagtcagagagacttgtactactcttactatgaaacaacaatacagtgcaacaatgctaaaataataacgctactactacactagtcagtaaaatgtgaacaaacaggacactggtaaatacatgtacacacaacaatgcatccggtacaactttgcaaaagtatctctcagtacaactcttcccttagactatatgctaatgctaattttatatcctatattttacattttagaaaacacctctaatagatttctctctcgctgacattatgttttaattaaaactctgatcacgcacgcaatgcacattaacctaataaacgtaaccgattcccagcacgtgtaccacaactgtatgttttgatatttatttatgacttggtagtctaaaaaattaaatcaaattgttagtctaaaaaattaaatcaaactgttagtctaaaaaacaagaattattagtattctaaaaaacaagaattattagtattctaaaaaacaagaattgtcagtattctaaaaaataaaaagtatcattattctaaaaaactaaaacacacgcacacacaatcctttaacatttcgaccctaattcaatgcaaagttgcaagacaaaaggtatcagtggtttttgtcaaacacacagcatactacaaagtaagattcaaatagcaagtcaaagtttgaataggtagcagtggttgtaatagtttacgattcctttattctaggttacttaactcaactactttactacatactttagcgcctactctactatatgctttgcaccctactttacctcctacttacctcctactttactccctacttacatctactttaccaaaaaactaaaactaatctaaagactacattcattcattactattctctaaacttatagctagatgcatttattagtaaatctattgaatacatctattgaatacatacatttattgaatccatacatctactgctacatacatctatcgatgcctacatttattgaatacacacatctattgatacatcatcaacatcatctaaaactctaccaccaacacatttactttttagaacgcttatcggccggctcagactccgcctcttcctcttcagcatggtcaacttcctcaacgtccgccttcttggaagctgtgctatttttgtccttctcctcgctagaatgggaacgcttctttggcaacgtagtgctcataatggaaccgccgccaccttggtggtccatcttgtccaataaatcttccaacattttaatgtagtgtgtaaactcttcaatgttgtcgttaaagtgcaccaagtgcagcttttcaatcaacatcgtaatcaaactggacaggttgctcttggacagtctggctgccactatgcgcatcctgaccggcagattggacactacaacgtgctcgctgtcatcgcaaatcaaccggtgcatctgcagcttgtacatttccattttgccagatgtcttgtgattgaacgatgccacactgggagtcttgaagtatttaatgttggcaaacttttcatcgtgatcggccatcatccaagtgtagccgttagactctttgacggtgggcgcgtgcttcagtacggaatcgtccaatatgcaatagccaaagatgaggttcttggcatcggcaaccaggtgcacctgcttgacagtgacctttgtcagaatgttgcgcagcacctcattggctttggccgtcttgatgagcacactcttgcaactggccgaaatcttggtgggatcagagccgggttccagttcgagttcattggcaacgctacgccatctggcaacatcggtggtgtactgtcgctgaatcaagtctgcgcagccgacaatcttgtacactttgggaggcgttacatacttgtagtccatgttgtactttagtgagactagctcttttacgatcaaacaatcgcacgggccattgtacatttccagtttgttgctgcttgtcggcagcgatttaaaagtaatctgcatgggcggcttgctcacaaacagacttgcaatcttggccaagcgatcggtgtacgtaaacatttcaatatccagaccgttgaccgatagtaaatctacaatgtgcaactgctggccattgtacacgacaacgtcaaaagtgtacactcccggtattacggcatcgataactttaacgtactcgtcaaaacaggccggagaccaatgaaggggctttagatcttctacaagctcaccgggtatgcgttcgtaaaacgacaaagtcttgttgaacgagtcgagtttcaagattgtctgaaaatctccactctcatagtacatgtaatcggtgagctcctggtgggtgatggacttggttttcggtacgcggttcatggtgtcgagttaaattatcgtcaaatgcaaaaggttaaagagtatgctcacacgcaaagtatgagaatgctcgcaacgcaatgcttcagaactacataaatgtgaaccgtttataacaccaataggctatacgcgttacggtcgataagctgtatataaatattaaaagtaaattttcataatttctgcagtcggccctctacacatggggcacttgtccaactgtttggtcacgcaccagccgcacgaaacgagatgcttgcacggtaatatcacaatatctgcacgatgcgaacagcacagcaggcactcaccctgacgatccgcagtgtcttgaacgaccgcagtcttgataaagaaccgcgcaaagttggcctttgactgagtcttgtgcataaacgtagagttttttgtaatgttgtacacaaagtctacaccctttattcgcaataggaagcgacaatttttggaacacttggcgtgctgaatccacggatcgtcctccggtagccatttcgagattcgtacaccgcacaagtaacattgcacttcgtcgcacatgttgctgtaaaaaaatccagcctctgccaacgagactggacactgttgcagaccgacgggccatctcgagaaactcttcaatctcgttgtaatattgcggtacagcaacagggattgcgtcaagtcaacatgagcggaggcggtcgacattttaccgatactgtggcccacagtgtttgttattgtgtgtagtatgcagaaccactagtgttagaggttttgtacgcgccttgtttacaccctttgaaaaaaagagtacccaagtgactgaggggttattagcttttatagcaggcttgtaaatgtgaggtgtgtgttgtagtgtacctttttatatttacatgtatttatatgaatttatatgcagttatatatttgtatatatttgtatgcagttgtatgtatttgtatgaagttgtatgtatttatatacatttataaatatgtgtagtgtcagtagatggattgtgtttacaataaaagtacattttgagtttaaatctaaccacactgtttaatggctaattctaaatctattttatactctttaaatctaataacaactctttctaaatctaatatcaactctatttctaaatctaacaccaactctttctaaatctaataccaactctatttctaaatctacttgtgtattactaaatgtaaaccatttaaacatgtacttccaactgtatttctaactgtagttctaaatatagtttaattctaaattcaaactgaacctattctaagacactaatctaaaattaacaaccaccacagaatgagcataaaagtagtactatgaaaagtagtatgaaaagtagtctgaatagtagtatgaaaggtagtatgaaaagtagtctgaaaaggatcagtatgtagagacaagttacaatagtgtgaaaatgatcaagatgaaattaaaagtagttttaattgaatcattctagttttttgatctacaattgtgtgcattaaaaacattatttcatttaaactgtgtttagatatcccgttgttttgaacttgtaacaattacaccgacgtcaacttcaaactccaaccttggttacaccaccaccaccgatgcgtccgtttgctgatgttgatccatcttctgaatctccgtgttggtggacgcgtcaactgtaagaaactttggggatgagtaccggggaggcggcttataacaaggtggaggagtgcgttcaaacgaattggaaatggaaaggagtgcggtgcgttcgatagacttgtttatagaattgctaataacgccatttagtgaatctatgcgattgtaaaagcaatacgaagacgatgaagatgaggccgagtccagtgaagagtttgatggcatgtaattattaccaccggtcaacgtttgtgtggaccgatccatcagacgacaatggtcctcgtccgtctgcgtgatgccgacattggtctcgacactagtctggcagccaatggtgttgctagtcttgatttcagagtagtctggagcctgatcatagtattctggctccgagtaggtttccgactcgttgcaagattcataataggaagtgttgatstyscrstcgacatkgmsksytggkgmaytcgatkttgttgaatgccagactttggttatactgattaaagggagcattctggttaaatgactgaatctgattaaactgattgtgcatctgatccagtgcctggttctggctgctatagttttgtggtttgtaatactgatgaaaatgcataaaattgtcaatgtttgtatacttgctagtgttgttggtgttggtgttgctatggttattgattcctgtattattgtttgcaataaaattgttggtactgytttgagtattgtacttgttggcctttctggacacatcctcagacttgatgacaatctgtatagtttyaaactctggccgtggttcastgtccgaggtgcagtcttcgtccacgtacacgctacactntaktgggccactattgttgatgtaaatcactttaccgcaatcgtccctgtagtagggttcgtcsbcaatgtartmacttgcatcctcatycctctttcrkcctthsgatgcagctacaaagggyctattgttccaagwttcastgtgcaaccgttatagtsctgggatgatctgtcgattgatgctgavggtwgaagactgnakggttgaatttkaggawgkwtcstttvattgrasgctgrgaaygcsactcavhtbgaggwyttgatgcadgaagstgatggaacgcgttngtadgwatttgwatgkgttccwtccdttmtaggatgttadwttcktgatctgtaagggatwchattawthggggatattmagaawykcctawtvtgatactkgtgtnnccarstggaagrttaaatacwttcycaaattgaaancntttcccaaaanactcttnaccctgaaggttgtntncctcgtcacccngncgtnagcgncannaagtgtnngtnagttcancgnnntcataaanagnatattttaaannaaannannnngaannagnacgancngnantnanngctnccaattgangaggcganncgtgcggantaatancntcantgntcacanggngntcgngttcngagntaaggangngtantctngtnaatannnngcaaggagtnncnagnggngcncangnagtananaagnganncggcncgnngtatacnnattangnccattntnntcanganngacnaataanctngnccancctnngctnangtncggcttnagccgaggnatagcnctacncggnnctcnnngtacnannnttcnantcncagncnncanngnanntggngngntnaacngnaccangaantgcnnantgnctnacagtaaatnnnatntacggtganttataanngacaggtaggatnaagngtnnaccantataagatcanntctagcangtacnnagccacgaanggtgccnnatctccccnctaaatgtntnnatcnncacatnaactatcnttnttatcantnaactgntatttgactataaatagccggcatgagctattggatntnatngtcnaaccagttgnantcaagagtntagcatgttagacatggccctattnnaaactaactgtnancacnnttnggcaaaaaatcatggttctactgaaccattaaactgaggmattcgawatgtgtaaagacaagsatttgtagatggatttgtagaaggktacatttagakttcaacttgatatacatataggtacactgattttataaacatctttttactatacacatagagatgtatattgtaggagtttgacatttatattaacatttacatttaaacattgctctaaaaacaaatgcacgcacacacatatttatcaaccaagtacctgctaagagcagatcacactaatcataccgtgtaaataatcaccctctgaatcaggtcaactatccttgcggctactattattgtaatagcatttacaattggtataaattaacgacggtctggctcggttatagtttgaacattttgaagggtccaacactaaagtggaaacattagcagcagcaacagtagtggctgcaatattgttctacaattgaaattacaagtttacttgcaagttttggtaatgcacaaagggacgtttacaactcaccaatggtctcgtctacgtagattatccgaggccgattgcgtacattgcagcgctccggtgtcggtggtcttgcacgacgtccaatgtcagagttttccaatcgttgaatcatacgcttgagcgataaattggagtttatcgaaatgttggtattggtcgatgcatctgtggaggatagagggagagagtgttttatatggtacttttgttaagaggttaattttattggttatttgtacatgcatgtataaacaatgtgtattaaggaagcgtgcattgacaatgtgtaattcaggaaacgagtgtctgtcaatagaaaatgtacaaaacagttaccgctagtgttgattgtttcaatcctgctggcatctatattgacgtctgtagagttgtagtcctctgtgttgtactctgtagtttcgtctgtgttttcatctgtatcttcatttgtgttttcatcagtattttcatcagtatgttcatctgtatcgtcagttgtgttttcctcagtattttcatttgtattctcatctgtattatattctgtattatcttcagtagtctcgcctacattagtagcatcttcattggtggcatattctgcatccacatctacatctacctctgcattacttgattcggcatccacatttacatctacattacttgattccacattacgtgatcccacattatttgactccacattacttgactccactccagcattgccagatcctgtattggaattgctcacctctgatacctccgagtctacatctataatacttgtctcgataacgttgctggtatcaataatgccaccatcaacagtactcccatcaatagtgctcccatcaacagtgctaccatcaacagttctaccattaaccacaacaacactagactcctccacaacaccatccttgttggaattatccatagtgttagccttctcaatagcactagcacctctacctctctccatattgtcaacatctacattgggagtcgcatctgtagattcaaaactttcaacaatactcctcttgactcggtgcagtttgcatctgcgcatagtactgttgtagtcatttttagaaatgtattcattcttgttgtactcattcttgttgtactcattcttgttgtactcatttttgttgtactcattcttgttgtattcatttttagaaatggcccggtactctatgaaagagcctttgtgtacacttttagaagcatccataaattgctcatcctccgagtcttgtatgaccacgggcgttgcgctaatcgttgcccgattgctgtacacgttgctactgtcctctgagcaatctgaagagacgctagtgtttatgctgccgtatcggacattcttcaagtctacaatattgccggcagcaatagtatcagcaggattgcaatcagtgtactcaaatgaaccaagtacaggttcggcatccgtgctgcaagattgtccacgtcgtacattctctccagtgccagctttgtcaaattggcaatcattgcactctgaggagtctgcaccacaaccaccaccttgaatggacatggaatgggatgtttaaatatttacaaaggttagtgtgtattatgcagaggtggaatgtaacagtacagagagagcgagcgagtatagtttagattaaatgtgacttttagatttttttatatgtatgcctgaattaaataaatgatgcagatgaaatggtttacgacactctaaatttattgcaaactcaagttataggcaaactaaatttataaccaaactcaatttataaacaaattcaatttatagataaaatcaatttatagacaaaattaatttaatttatctacacttgaaggatgcacactcaagggatcgtttattctactttttgcagcaatttaattaccgtccagtgagagtataaatataagagagtgtaaatttagtcgatacatgtgcacaagtacaggtgttcatttataaatgttaaaaacaacactaaatattaaaacaacaataatagtaacaacaaccaacacaactcacccagaatcctcttctttatcgactctacgtagagtgggccctttttgtacagtaaaaacacgcatcggtcaaagtgtatggcatgctgttcccagggatcatcgcacgggttccaatcgtttagtccgccgtcgcaatagaaacactttgtacaatcgaccatgccagcataaaagaatcccgcctcggccaacgctatcggagtgggcctcttgaacacgctccagttgccgataaacgaatcgagtctcgacttgaaataccgatactggggattagcgtacatgggcagatttgcgtacgcatactcgcaagttggtgacaaacgaatgtgtatcaattgaggtttgtttacaaactcttggtactctttgctgttccacaagaggatgcacttgcaaaaggtacactttaatatatttgctccacagaaatagaaaccagttttggccaatttcatacccagaatcatcgagtccttccagttggagctcgtaaaagtttcgattctctcaatttcattcatctcgctgatgtgcacaaaacactgtttttaaattaaatttagtacgcaaacgtagcctcaataggttattgcttttatgatatttaacgtttatatggctatttaaaaatgacaccgacctacactaaaagtataataataactacaccgaaccaacagtccatttaacactgctgacagacgacgactagtggtgttattgagaagtcgtgagaaataatcacctccccaccaaacctctacaactatactacactactactgtagcttggctgataataataatatttaatatcaatttgcaaccgagcccattgctagacaagtttacaccacattgactacagtgtaacttaatttatagcataaatgtgtagtatctactactacatctatacgtttattgatattattcattctgtagagtttacaatttctaatcagaggttgtaaaactgtaatgtggttattattgttaataataataatcataatacagattagttaatggtagagtgccgttgataatttattatccggtttttatttaattttataatttaacttatctcggtctctagatacaacatttatttacagcttgctttttattgtttccctttttatagcatcatttccgggcaaaactatatagagagttggagcctttctctctcctagaaaagatatctaattttatagaggatctaaattatactgttatttaagattatttacatcaagattatttataatgagcaacgtaaaggcgtcccatttaaagctcttgaacgatctaaagattaacattgaaacgctcaaagattccaacataaagagcgtctttgagcaaattacaaaggagcgtcccaaacttacggacaactacaagattagcatattgaccacgatcaagtctctcaatccccgagtcactctgacctatcccaagattggactgttgcaacaaaagagcggaactctgaccggtagcgtgattaaaaactttaccatcacccttgtgcgattgattcaagagtttaaaacgtttacagtcaacgacatgggcatggtcaatttgcgcacaatcgataccgtcatcgcttcgtgcctccatctgtgcacccgtgtaccgatcgcacacctggaatcgttaaagtacacgcacctaatcaatcagacaccgtacacggccaatcgccggcaatatgtgctcagacgagtcgagccgctctacacgatcctattgccggtgatcaaacatgcactcttgatcaaacgacactttacgtttcaagtgaacccattggccatggacgaggactcgatagactttataccactagactataaaatggtgacggttaggcacgatgcaatcaacaagactcttagggaatcgtacatgcgttacattatggacacaccgaccacatcgttgggcttgatcaagctaaagattgtcaatcggaatctattgttgacaatgctgcgcgatgaagactatggattcacagaggatgtaggaggaggaggaggaggaggaggattaggagatggagacagtgatgacgataaaggaaacaatgcaccatccaatacaaacaatgcatcgttcaatctattgaattttgaaagtggtagcaacaactacaacaactacaacaacaaccaggataccaatacagagtttgatacaaatttaaagcttccaaaaaatgaaaagcctagaaaaccaatggatcccggagacttgctgagactggcactgctcgatgccggtatagattttagtaaaatgacacctgcatcggagagtaccggcactggtaccggtgctgtcactggagccaatatgagcaatactgggactgttggcatcaatggtaatgtcggactctctggcggcattgataatgagactatacaaaacttgaaagatgagatgatgcgaggagtcagagagtctcgatatacagataccgatacaaaaacaggtataaatacaggtataggtacagatgcaaatacagtaccctcaagtatacttgaccctacactaagagtagccaagcttgagcccattactactccaacatctagacccattcctaacttggcagctataaatactctaaagtctactactactgctactaaacctatcactaaatccactaatgaacctactactcttaaacctactaaaccacctaccatcaaacctattcctaaaccacccactaccaaacctattcctactccaacacagaaacctacaatatcagtaaaatccacaactctactaaaacatcctccgatgcaacaaatgcctcaatcatccaagcaacaaatgcctcaatctcccgaaaccacccgtaaacgtccgagtacaccatttgtggtgcctcctcagatagaagattacgacgacgacgatgaagatgtggacgaagaggacggatacatttacgacgactatgcagagtttgccgacgactctaatctaactttggatttcgaaaacgattcgaacatattgaacgtgcaaagcaacgattacaacaatactcggcagagcgataacaccaatacgataaacgaacaaagttacaagccgtttattaaagaatctgctatcggtggtgcaaacaatgcagccagtattaacagtgtgaataatgtgtcatacaatgtagcaaacaatggaactgcagaaagattcaaaggcagacgacctgtgcaccgagagagcgtacaggataccttatccatgttcacagagggctaccaagatgacgatttgaacgcggacaaggaggtttcgaaaactgatgccatcatcgatgcgatcaatcgcagccgaatccatcatctgaaaccggatcgaccgttgattgatcgcaaacgaccgctaccgccaagggtggaggttttgaatacttcggcattcggaccgcagccgtatcctctactggcgccgtaccgagtgcccagcaatctgggaatcgtagactcggacgattacgagtacgatgcgagtacgattcgcgatcctgactacgaggcgtacatggccaaacgtagtcggatcgatagcgcagatgttatgaacaaggttgagcggttaaatctaatggaaagattaaatagagccagtactagtactggtggtaattctttaaattgatttgtgtgtatttcaagttaaacgtaggcacctatcaaagtatcaaagtatttagtatttgttgtagtacctaattgatttgttacacttgtattgttaattgttaaaaatatagttttagaataatgttgactttgttttttagaatttaccatccttcttatccgttagaaataaacacaatggttacactcatagagattggccgattcctcaacggctatgctaaaaactcggaacagctaactctgtggctgaccagcatggatgccgaatccatgtactgttgcatacgattgtttatagacaaaaagtggcgtcgtcaactcatcgcaacgtggaggactgccaaaaaggttgtcatcaatatgcacgacaagtgtgcatgtttgaatcgttggggcaacctgatatccaaacagattctccaacagattggcaagtgtgactatgagtcgttcgaagacgacgacgcaaccagactgatttgcaaactactagtggatcaggacgagggctttgtctactatagcgataaagtgtttcgaagcggttgtagtaaaattgaatttatagacactgtaaaattggagccttgcaataaacgccgtagtcaacagtgtgcgtcatttgaacgtctagacgtaaactatcaagagtgcggccaagatgccagtaattattattgtcctaaaaaacaaaccaacgacgacagactgaccattgtacaattgttcaagacaccgcatcatttaatcttgaaacaatgcacaccgctagaggcctacattatatcgtcgatgagtctcaatgtgaccgtcaacgatctgactcgcagtctgcccgaatactaccgattcggcatacgcaacgacatcaaggatcaacccatagtgtttgatctttttcacggcatgtacaactttcacgtggcacgtagtgtctttacgtgcgacaccaatctgatggcctactacaaactgccgagcgtatcttacgagacagaggccacgctcaacgtttccgatctggacgccatgtgcagcgactattgcgtacagcccagcttcaagggagtccacctgtgtctgtgcctaacggaagactgcaagtactacatgctaaacaggcacggtgtacgggtgcgaatcaacaatcgagccatcctacgagcactgccctcggtcaagggtctgtcgtacttttgcggagagtttatgctcatgggctacggtacgtccgatgtagagtgctgtctgcgatcgtactcttcgagttcgcgatgcatcaacggcaacgatgaagcctactgttttgtactgttggatctctatctggtcaatggtaaatccatactggacaatacgtacgaggaacgcttggatgtggccagacgtgtatttgccgattgctacacttcggatgagccctttgggggagatattttcaaggaagatgatgaggttgatgtagattctaatagttctagtagtgctagcatttctaacaattctagcagttctaataattctaacaattctaacaattcaacatgtacaactgagaataaagacaaggaccattcatcaacattaaccacagacggcacagaatacattgaaattgatccaggagaagacttgcaattacacttggattctataaaactaaaatctgaagcagaacgtaaaacaaggtccagatcatctgaatgtgaatctggtgcatatggcaccgataccgactctggttctggtactgatactgactctgaatctgaacctgaacctgaacctggcactgacaccgactctgaatcctcatcactgaaacctaaagtaaaagtaaaggctagacgtacgcaagacacgctaatgaaaaagattaggcgttccatacgcaaccaaaaggtcaaaggagccggtcgattgtttatcgtagaaaactttaaggacagctctgaattgatcgagtttcagagcaaatgcgacaagtttgacttttacgccaacggtataatcatacggaagcgagcgtcggaaaacatgtgcaccaagattatcaagattccatttgagcgtcaacactggcgtctcgtagactcgcagggattcgaatgcgaagtgaccctgtccaagtatgacaatccgaccatgtgcgtagacgacctgtttccgtctcgactgtgggcaatcgaacagcaatcttgcgtccggtgcaagtttaacgcagtgtgttacggaacatcaggcgtcgacggcaacaatgaacgcatacgcatgcactttgctataaacaatggacaaggcgtttacgttcactttttcagtgtgcagtgcatctttagattttccacactgtgctacgacctggaccgagtggctaccgtgaaatcgtctcgcatcctcgtagacgacgaaccccacgaatggttcgtgtgccggctgggttttgccgaagcggaaccgcccttcaagacgctaaactcgctgagtgtacgctttgatctgtcgctgtcggattgtgtgaatttggcacatttccgtaacatgtaaagtgttgctattgtggtgcatagtgccaataccgtattggtgttgtatgcacccagtgtctagtttagagagtgccctattcacaatgactcttgaaacttgtcaaattgacgaaagctgcgaggtgcgcaggcccagaggtagatctcgctcacggtcacgatccaggtcgcgttctcgctctcgttcgggaaaccgtagcactgcccgatctggcagaggccgcagccgcagcaggagccgttctcgctcacgcagccgcagcaggggctccaggaggggaactcagatgtaaagagtgtagtgatttggtcaagtatagtttaatgcaatggtaaaaagtgtactggtaaaacgtatactggtaaaaagtatatttgtaaaaaaatatactggtaaaaagtacaactatacttgcagctgatttaatgttagagtatgtgtatgagtatgagtacgagtatgagtatgagccacactgatacacttatatagtgtacaaaagtaaacctcaagtctcggggtatagtgtataaaaataaacagagtaaatctcaagtctcggtagcagtatcgttcctgatttgtgtgtgtttattataatacttagtagatgcatttatttagtagattcatttagagatgcatttagtagatgcatttagatatccttggtaaatacctttagatatccttagcaaatacctttagtagctacatttaataaatacttgatccatgtttcctaatatttagcaatgtttaataattaataatacttgataaatgtctagtactgtaaaaatgttaaagtaatcatcaatttttttcaacaagagattagtctttttgtttgatacacatacacatacaccatgctaagatgcatggtctaattctactcttgacttttgtaacgtgcatctttctaattctaaacaagaacaattggattcaacaagagttggaacttcacagaaccttggcgtgtatgccttttctgaatcgtgactttatcctctacacgtatcatacgtttgcaccgttgtgtgagccagagccggaaacttcaacataacatgacatccctccagcaaagtgtagctcaagcaacccacgaaacgtaccacggagacgatgacatgaccgatgccaatactagtggaatcgtcaacaatgccaacaatcgaaacagaccacgcagactcagacgacgacgagtcagactggtcaatgccaaagcctatgcggcctacgttaagcacgccaaacgtttgccgtacattaacaagctaatgaaacaggtggccatgatgcatctggaacagtacgacaacgacgacgatagagcactggcctttgtgcgtcaaatgtacttgcgcaaagtcaaatggtccacgttcaagctctactttaggaaactgaaaccactcttttggcccgagaccaaagtgtttgtatcaccgatggtctttgatttgaacaacccacctcagaaccgtgacccggacacggaaaacattcaagtgttggtcaaggcactcaaagagctagtctccaccgatcgctatacgcaccccatactactagcctactatacagggttgcggtcggtggaggtgaatcgcatcaaagtcagccatctgtggcagttgttgcgcaaagacagaacgataccgctgaagcgcaaaaacggcaccgaatggcgagtctactactttaatcaatttgaagagtttctaggtaaactgtccgagttttacagtagggaactggaggcgtttgagcgctacggtatcgatgatgttttgttcaatcagtccacgtctacggtgagctaccatctgaaacgctactacatgaccgtgtgcaagtgcagaccgtatccgggttttggactgcacgtgtttcgatacaatctggccaccgttgtggagaatcgagaggttgcacgaatgattctcgaccacaaggatccccagacaacggaccggtactacatcaaagtcaaccatcccaagacgcagcagagaatcaacacgctaacggtgaccgatccggtgtatgctgcatgtgccaaagtctagagcgagagcttatggtacacaacattagcaaacaagtgtagtacaatagtgtacaaattgaaggttttcttagtttacgaccatgacgaattactacacgctgtgataaatcatgcatgatttttctagattatatgtgcctgtgtgtataatattcatacaatgtaaaagccagaaacaataaccctagtgttccactgactgaatagtagcactatacccactgcgttgaacctgagttttaagagtaaactaggtgtgtaaagtttatagctcaccgtacacctctaccttatcgcacacacatgtatgtgcacatgaatcggtcatctactatttaaggaggccgagatttgctttacaatcagacggccacagttggtgttttaccgttggtgggtacttcatttgtagtgtataataataattgctaggtatttatattcttgtattcttatattctgatattcttatattctggtattcttatattctgatattcttatattcgtattcttgagtatatgtatttgtgcattattcctgagtgaattgttttagtgtagagttgatgtttaattttcaatggttaatttgtaaaggtttaatttgtaaaggtttagtattcaatggttaatatctagtgtttaatattcctagttggtagtgttgtagttttttaatcaactttttactttacttaactatatatatttatttaataatattttaaataatattaaataatatttttaaataatattataaagtagtataaatagtataccaatagtgtttaaaaaacaagatacatcctcctaatacaagcaccctttgtgttacagtttaccatctgctagaaacacgtctaccaacaatcagtaacaaccatcagtatcaatcatcagtactatcaactaccagcaatatcaaccatcaacaacatcaactaccaacagcaactatagcaacatggcaaacctgttgctggtatgcagtctgtttgtcgtccttgtcaaatgttgcacttgttgtgagtataaaactgacgccggttgtctcgtcggacaagatgatcaggtaaccaatactgtcaattttctagggataccctatggtgtcggtcgtaggttcaacaatgccaaactgtacagggcctcaccaaacgacactatgcacgcagacactgacattgagtgcatccagggcgactctctgggcaccgaacactgtctcacactcaacgtgtacaagccccagggtacggtcgccgccagtaggtttcgagtcgtggtcgtggtgcacggtcgagactattacaagagcgatgcacactctgaacgacaccggtactcgcactttaccgatgccgactttatcgttgtccatgtaaactatcgattgtcagtgtttggctttctgtgcattgaccgagatttggcacctagcaatgtgggcgtgcacgatgtgcgtctggccgtacagtgggtcaagaggaacattgccgcattcaacggtgactcggaatcgataaacctactgggctacggatacggtgcagtcattgtgcacattcttgcctggaagggtctggtggtgcgcacagtcacaatgtttgactcgccgctcttgtacaacaccgactcttcgctgccctacaaaacagactcggtgtcggccataaacgaacaggccgtgtgtaccgattcggtcattaggagtgcccgtgtcttggagtttgccaaacgcttaaacttgaccaattcaaccgtggccagtaaacgcatcgagcgtcggttgctgctcaagttgaaacgtctcgacgccagagtactggtgcgtaccgtgcaccgagccgagacggcaactctgaatctgcacggtcaaacctccgatgccagtgtactggtccagttggacgcgtccggtgtgcagggtaacctcagccgaaacttgcccttttccgtgtgcattctcaatgctcgagatgcgttggattttgactttttcaatgtaccctttccggccaccactgtgccggtgctgattgccttcaacggcaacgatagtcgattcgacacactggacggctactggagcaatctgtacaattggcgtttggacagcaagcgtagcattctcaattatacgcattcagaggtggtggtaccattgttgatacactatctaaacacttggaacaacaacaaagccagtactgtaaagcatcagcaagagcttatcgtatcaaacactgaaacgtttctgttcaagcgttccgagaatcaacaatgtcccgatagctctcttgaccccgaatgtaaacattttcattattataacaacagtcgctttacactggaacgagttcctgttgcgacaaatgaaacagtaccctttgtttcaataatgaccactgttggcggttttaatgtgtccatttccgagtactttatcgatgctaaatcggtcggcgttggaagtattattaatggctacgctctaccaaatgttgaatcgggaacgctaaaatttaaatttaaccctctgactctgttacaatctgacgagccaagtgttgatgtagcatcagtgcaaagaggtgcaccacattttgaacctctaccagagctgttgttgtctagtgtaccagaggtggctactactttacatgatggttttactactactatacgtgatacttttacaaccactgctacattacctacactatccaacaatccaactagaccctctactacacacaattcaactcttccctctactacacacaaaccaactctacctacgagtatatttttaaaacccatcagaaaacctaataacggtaccactagcctcattccaatattcccattaaaacctaccataaagaatcaaacggcagtgcactctccgaatccggtcgaacagtacattatagatcagcaagagcaaacgctgagtagccttacaataataatgattatgatcctatgcaccttttctgcactcttgtttgttttagtgtgcaagtttgtagtggccctagtttgtatcagtatataacgaggtgctcgtcttttttcacaggcacatcgaaacaagcgtcacctgttgcaccatcatctgtttgccaagccgtgcaccaacaccacgaccaccataatcgacgaccacgacgagcacaaagacgaccctacaactctgcacaaaaacactacatccaccgttgtcagcaagcccaatggagacactgcaaacactactacgatgacggaagaggtcaaacctctggctagaactcgcagacaccacaaacacaagggctgcgatactgccaagtttatctgtataccgcgtctaatgtcgggtaataaaactattatcgtcgaggattagatgagagaaatattatagagagagtgtggtttgaaccctgtctacagtttatcatgtattatgccactaaacttgtttgattgatgcatcagtcttatctttatgtttgccgtgtttttatgtagatgcagagtggatgcattttttaatgtatttagttgaactgtttttaatgtgtatgtgtattctttaacattcatggttattctttaacattcatgtttacatgtgttgtatttgtttgtgtttaaaaaacaagattttatattttgtaaagtttttattaggtacctacttggaattgtaaacttaaatcttacatctaatgtatcttgcatctaaggtattttacatttaggacatcttacatctagaatatcttgcatccagaatatcttacatctaaagtatcttacatctagggcactcgcatgtattcttacatctagtatttacatttagcaactacacacatatgttttagacagttttacaatacacctaaaaatgcacactgcacttgtatttttcctttcctactaacaccagtctctgtgtatatctctctagacttttgtaaactatacactctatggcacccttttattgcagcttgtagtagtagcatagtaacatagtaatataattgcaccaaagcatatattgtacacatacacttttcgtgcattcagtttttgattcgtttggtgtgatttgattgtaggagacgtgatttgattgtaggagttgcactttgattgtaggctttgtgatttgattatacgttttgtgaggattttactacaggccttgattgcagtctatggctctgattgtaggctttgtttatggctcttgatttaaagattggtttgtatagtgtggtctggaggtaggattcaaaatcagaggttgatttttctcaagaggttttgtagtagtgttgtagattgttgtagattgttgtagattgttgtagattgttgtagattgttttgaatgaaaaactttggtacgggtagattccgattctggtttgggttctactagcatggtcagtatgtttgtcgtgcaatacagtggcccctgttttgcactacttaatccaaatgcacctcgttgccccattccgaggcactttcgtcatcgtcatcctcatcggtactggcaccatagtcggtggcctcttcgctactactactgtagtcatcgtcatcatcatccgcattctcaccctcttcggtgctcgtacccaaaccctcgtcatctgtttgatcttgtcgagagtggtgtgcatttgcagcatagccagaagtcaatctggccagtacgcttcccagtatgaagcccatcaggaagccgacaattatttcaatcttgcatcggcacgtcgagtcgttgcactggtagtagaggtctcccatcaagtgttgaatatcatcgactatgctgtgattgctcaaagggtagtctgaaagactaatggttaaatcttccaaatcaaactcggtctctgatgttggctttcgcaagagactcattgttagaggggtttgatggaggagttgtttggagaggtgttgtagtgtatgtaaaatatactagatcagagtagaatggataggatagagcagaatggataggatagagtagaatggataggctagagtagaacagataggatagagtagaacccgttaggatgctccactattgtgaatgttgaactactgtttgaatttgtattgttcttccatctatataataaacgaatgcacgaactttttagttttatttgattctaagcatcccaaaactaccagtacttgaatgcacagagctacaacatttgccaaataccgagtctaaaaaactagaatcactagtcttctaaaaaactagaacccctagcacctaaaagagtaggaggttgaatcagtctaaaaaactagaacaactcggaaatgcaaagcccccaactttcaagtgtctaggaaatgcctctgaatagtagcatgtttgaatgtttagaaatgcgcgcacaccagagtgtattctacaatagtcgtgcttcttataccaccaatagcgtattatccataattgcatactcactttataggtagctgtaaagctttttcctatgcatgactgttttgtgaatcatggtatttttttaaacggacacgttttcaacatccggtggttggagtatataaacttgcaattgcagataagctcatcattctgtgtactgcaaccctcggagcagcactggtctagtaattatcatcaaaggtctagcatcatcctagtagccccaaccatgtgccctccatccctctaccagttggccattctgcgcgtcatcaagagtgccaaactcagttcggccaagtctttggaacaattgcccaaaccggtggtcgaagacatcaaggcggtacaaactctgcccaagggttggaggtatgccactatgatgcacaacttttgcgactctcgagactacatcggcagcgggttcattctggtgccgtccgagtacgatcagcgcgaaatggaccggctggtcgactacgttggctgtccgtgcatcgaatcgggcctggcttcgatccgtagcggcgagtgcatgtttgctgaactgcgcaaggctgaagtgttccattacctgttgcacaaactctaccagattggtatgaatgtgcgcagcaacattcggtgtctgtacacgttcgacgagtgcactcagttggagtacatgtacagcgtgcctcgtaggacctactttgacctgatggatcggtgggagacaccgctcaagtcgagcctggtagactacaaggtgcccgagtatgtaatcttgggaaagttggcgtttcgcttctctggccagttgtacactgaaatgaagcccagacactttgtccggaatcgtttggtcaagcaacccgagctggtgtcgtacttggaaaagtgtcgcaaacgccacataaaggagcaccaagagggcaccatcaagcggattaaagtgcatcactcggtggaggtggagacctactatggtgttggtttaaactttgatgtttagagactgaggttaaagttggagttgacgttggagttgacgttagagttggtggtagttttagttttttagtgttgtatattgtatattttgacttgtaaattacttgtaacttgtactgtatatattagtgtataaattagtgtataagagtgtatatgattgtatatagtagatgtactagacatgtaagatgaaatagacttgtaagagattttgtaaatattaaagagtatgtaaacatacagctagatgtgaccaatgtgatttgtactaaacttgaaataaacaaagtttctatatattcaaatgtcttttattcccaacattaatcaacctactcttggaaatcaaactaggtactcttgtaaatcaacctactcttgtaaatcaaaaagtgtcttggcaatgaagccagaggcaatttacacaatctagaattgtgcttgtaatgcgtgtatcggttacgcagcagcaaagcaatcacgtttccaacacccgagtggaaattgaacggattcaattttacacgagtcaacttctagacctttgattctgtatttttgcttgaaccggcacaggcatttttagtaccaaaactctcgtttacgaccgtatagattgaattttgtgaaactccagattgaatttcatgatgatttatagtcaatatacagactgcggtttaatggcttaaaatttgagatatttcataatccaatttacaacattaaaacctcgaattttgcattgaattttgagatgctcagttttgcattttgcgatattgtactctgaattttgtaatgttgaattctgtattttgtgatggcatacttaaatcagtgttttaaattttgtgatactgtactttaaattttgtgatattctgctttgaattttggaatagtatagtttgaattttggaatagtatagtttgaattttggaatattatactctgaattttggaatactatactctgaatttagaatattgtacacgtgctacgagtctttaaagtgggtgtatagtatcaagtgataataacaagtatcaagtgataataacaagtatcaagtgacaatgtaacaatacaacaatagatacattgatgctaaaaaataaaaatagatgtaacacagattcaatttctttcagttcatttcattccagttcaatacaatagaatacaacacttgctcaaaacagtgttgtttaaatataaccatttgtaaatgattaaaatattttgcaactacctaatctaacagctaacatctaatatggcactctttgtgatgaacctttaggtcatgtgtatatctatacccactctacctctctacatctctctcccattctacacatttagcaacttgtaaatcaaaacccccaacaacttggccggacctcgtatggttagcgtcatcagagtgtagccctttgcctcggctatggctctgtactcttgcagttcgagctgtgtaaacggttgcagaaacactgccacctttaggttgtcgatcatgatcagagcgtcgtcctctttgggcacgctatacttgatgggcttgtcgatgatgcgtctctcggggctgtcaaagaggcacaagtctttagggtagcacaggtaggcataggcaaagccctggttgaccagtctacagaatcgagccatggcaccgaacgttagtcggctgcgataattaatcttgtgcacgttcagagtgcactccatctgtttacgagtgaagcccatccaggagagaacctctttggattcggtcagacgacgggccaggtcagagtgcttggtagtgtggtgcattgcagccaggatctgtagaaatccagtgcgtgtaatgtacagagtgtcggtttcgtcatctttcaagttttggtaggcgtcgtctacgtgttcgaccatcaagtgtcgatcaaagcccagaacctctgccagttcgttggcgttgattgcaccgttctcgactgacactggacgattcaaaagtaccaaatttgacatgacgtataggggatgcacactgcgcttaacaagcaacatgtcttattacagggttgattcattgaaaataaatttgtaattttcaataaagtatacactgggtgtgtatgcaaaagtggcacattttgagctcagtgtgtttacacagagttggtgctctcctacagagggtagggtatgtttgcatgtatagagcctccgactttggtttagctagtttccctaaattgtatgagcctccgactttggtttagctaggttccctaacttgtgtgcaactttggtataaatgaagggtatgactgaagggtatgaatgaatgtagaaatcaatgtataaatgaaatcacaagttggtagttgaactaatatttattttcatagaataacataaaatgatataatagtataataacaaataatgtaaaataatgtaataatataataacacagtttataaaacaccacagtttagagtttacatttaatgtataacatgatcaatatacaatccttaaatctacatttgttcaatatttgttcttacaattatttcttacaactatatacattgcaattatttcttacatctatatacattacaaatctttcttacaactatatacataacaattattccttacaactataaacattaaactacaactcatcctcaacatcagcatcctcatcggcctcgtcaacatcatcatcatcatcctcatccctaccgttaatcttttgcaacgactctatacaacacttgagcagttcaactgcatcattttgtgacaaacacagggcacgctttacagtctcgacagttggcaactttaacgatttacgactattgttgaggatgcacgcctctagggcctctcggtaatctaccaagtgtctgggcagattcatagttagcttttccaacagactacccaccctgatgctgacaccactggttgatttgaattttctaagtatacgttcgcgcctacgctccagtttgcacaagagcacctcgtccgagtcatcaatgtcagcaagcctagcctcgatggctttaaaactcttttaccagctttttcagctgggaccaattgttggatttggccaactcttttaccgcgaccctagtcttggtgacattgatgcgcttttgttttttagacttggactttttgggtgttgaagtggacgcacgctgttccactgtatcatcaaaataactactccagttcttttgagagttgagattagacgagtccatacgctctagaaaacgcttgtacgatacactagactcgatgtttgattttacagtggatgttggttgttctgggtttggggttgactgttctgggattgacggttctggtacaaactgttctggtacagactcgggttctggttcttgttctggctcagtttcaacctcatacatatcctcctgttcagattcattctcacgctcagatgcattctcacgttcagattcattctcacaatcagatgcattctcatgttccgattcatcctcatgttgaggttcgtgttccgactcatcctcatgctcagattcaggatattcacattcacactcggattcgggttcagagccatcttcaacacattccgattctacaaacttggaaccgttacgctctacgcgttcgtcctcggaaccctcatcgtccgattcatattcacgctcagattcactctcggattcacgattagattcatgctccgagtcactctcagattcatcctcaacctcattctcagattcacgttcaggttcacgttcaggttcacgcataagttcatcctcaacctcattctcagattcacactatggttcacgcataggttgatcctcatcctcaacctcattgtcagattcagattcatactcgaccgtatccatctcggtaacatggttctcattttcattactgtcaacaacacttgtagtaacattgtcctcatcaacacgctcactaacaataatacaaacattactaccaacattattaccaacaccatcctccaacctaggcctctttggactaccatctggatacaagggtacaggtttgaacatttcattcgaatcgacacaactgtctacaaaagtggtcaactctgtgtccatgtcaaaatctttggatctacgacgcttgagcggtgatggggttgttgttgtttgaatttgaacatcctcatcatcgctcaactcgatggactgcaaattgtccatagttacatctacaacactgtcgctagaaacgctctgagccttttgcttgtcattgaaattctcaacttcagaatcaaactcactgtcagatagaatctttctggctttatcgacatcgtcagatgggacagaggacgagttggacctttccagttcaaagtcaatggtgaattgagtgattttagtttgaacagttttaggtttactggtagattcattggaaggtttgctagggctagatggtttagagggtttggttgatttggatgttgatggtttagaaccatcacagtcaccctcctcaccctcatcagaaatgtacaactcgtcctcccatgaaatatcggccgtgtcaggagatcccatgtctatgaccggtgaagccggctctatcctaactgtatgttgagactcatcatcatcgtcctccaactcggtaatttcaacagtcggctgttgttcgtcagagtccgactcttctacaccatcatcaacgcgtaccagagaacgttcatcgttttcgttaatctcatgcaaaacctgtttaaccctatcgatacgtacaccgtccacaatcattgtggagacttcgagcagtttggtagagttgcgattcggttcggaacacttcatcgtacgctttaccctaatctcattgtaatttgcgtcgctagtcttggtgaccttccagttggcccccttttcgggaggcagttctatagagtcgtcggaatcgtaataagcatcatcggtgacctctgaaaagtctgaatcgtaaccgtcatagttgaaatacttgtcatagttggtcggggaatcgttggctcgattctcttcattgtttgggtcgagaaggtctgccagttcgggatcaatgtcaatattggcactgttagtattgttagtgttgttggtattgatagcattgttagtatcgttagtatcaggtctctcgtaggttgcaccaaacaactcttccaataatgcaatgtttgcctctacttgttcaggagtgggtttgggtttggatgatgttggagtgtaagtctctacgtttgtaggttcagtactctcagattcaacattctcctctacatttgtcggttcagtaatctctacatttgtatggtcattagtctctacatttgtatggtcaatagtctcggtctctacagttggaacatcagattcgtactcagagtcggaaatgtaagcagtctcaatgtccatgggctcggttaccactggctcggttgccattggctcggtttgctgtggctgtggctcatttacattagatgtcgactcagcatttacattagatgtagactcggatggagtctctactgtaagctccggggactctacattatcgtaacaagaacaacacatgcagcattcagttacgggttcgtcagttgcacaagatgcattagtagagggctcctctacactagttgaattgtttacatttacattagaggatggttcagaattgagagcagatggagcctcgttggaaattgcccgagtggcctcttgttgagatgcacgagcttcaatgtccgagtctgagtcaaacacttctaccatgtcaagagttggcctaacatagaacaagtcctcgtcaatggaaacctctgcggcttggaaagtcttggcttggaatgttttagattgaactaccacatcaggattgttggtatcgcattcggcaaaggcactcaccggctgagcaatggccgcttcggcttcgctaatgggaggtcttggtggtctattgcgcagagagtcaatctctccgtttaggtagtggcttaaaatcatatctaggatttgggcggttgttaatcggttagatgaggatgaggttgaggttgaggttgaggttgaggcagttgaagtgttggattttgatgtaggtttggatgtatgtttagaggttggttttgatgttggttttgatgtagatttagaggttgagttagaggttgagttagatgatggagcaggcttggatgaggatgttgttgttggtgtaggtttggataaagttggtttagaaacaggtgtagtgttagtagtggtagtagtattagtagtcttgtctgatggcttttcagagggtttggatgaagttggttgtttagaaacagaatcgggtttagtaggcttggatgtaggtttggttagtgttgaagtaggcttgggtgtaggtttggttagtgttgaagtaggcttggatgtaggcttggatgaagttggttgtttagaaacagactcgggtttagaagcaggtttggatgtaggtttggatgaagtaggtttggatggtgttggttgtttagaaacagaatcgggcttagaagcaggcttgggtgtaggagttgaagcaggcttgggtgtaggatttgaagttgaaccaggcttgggtgtaggatttgaagttgaaacaggtttgggtgtaggatttgaagttgaagcaggctttggtgtaggcttggatacatgcttagatgcagttttagaagcagagttggcctcggcaggcttggctgtaggagtaacctttgctacaggcttggaagcagcagatttagacttggaactagacgagtggtgtttagaggaatgcttagagttggaggaatgcttacagttggaggactgcgtagagcttgaatgtttagagtcagacttggatgaatgcttactggaagaggagctcttagagctagaatgtttgggtagcttagaagagctcttggatttggttttaaaactggcactgtacttggagttggatttaaacttggaacttttagagccaaacggttgcggtatgggaccagatgaaacgagttcaatgtcagagtcagagtcgtagtcggattcagagtcgctgctgctgctactactgctgctactactcattataaccctagccctagaccgagcggatgaaatggacattacctcatcgtcgctgtcctcttcgtcctcgccaacccttatgtctctaccgcaatcgtacttgtagtcgctaggtgtatagccgctgttgctatttttaccagaagtgtttttaccagaaccattgttggaactagaacggttggaaccaaaactgttgcttaccttggagcttgcatcagaactcgcatcagaactagagcttacaccagtattaacactagagtttacattatcaacagctttgctagaactgacaccactagtactagcattcgcatccttagagcaatcactagaaccaccgacaccacctcctgaaccagtgccagcattggcagcaatgttggtacaagtgtttacaaaatacgaactaaccaccgacggcggcggctgctgcatctggggctgaacaaacggatgcaaaatggactcggcactctttgctggttgcttggtggtagactgaatgtcggcctgcatctcgttccacaagagcatcatattggcactgctaatgttggcaaagttcagaaaggtcgagtcggtagagatcttttcacgcagattcctagcacatacatactctctgctcaaacgccaattgttgtgatcgtcatcgttaatgttcatatcgaaaaaggtctcgttaaaggactgaatgattctaatgggagcgtacccgtccccgagcagagttagacagttcaacaatttgcttttgagcagacactttaaatctacagtaatctcgtactctttgatgaccatggcggattgatcctctcgtaccttttgatgcaagtcaatcaaaaagtttaaacatccaaatattacagacaccgaaaagagttccttcaaaatcaccttctcctgagagtcttcgcagcgcagaccacgaaactcgggaagcatctccttgatgtgctccagcggcttgggttctcggatcacgacacgtttggtaatgtcgcaagtgcgaagtctcttgatgttgcccggagtcacggcaatggcagtgtacttgacgagcacattgcctcgctgacgaccatcgccattgtagcgaaacacgtacgtaccatacaggcacgaccactctttggtcatgtctagtccaagagcaccggtagacatgattgtagaggagagttgaacacttgtgtaaatcactagtatcagagtcaatcacttggtaaagtttgctcactagtgttggagtcaatcactagtatcagagttggcacttgtactagagttgtagcacagacttgtgattttaccgagttggaatttcagaataaaaactccaaaactcggagaataacagtatttatccgcacagagtccgtacactgactgaataaacaggaaaatgtacgtacagcagggtggctaaagctattatgtagccaacacctaccattatcgtatttatatgaagaattttcagtgggcgtacggtaggtatctggaacatattaaaattgctgttaaattaatgttaaattgctgttaaagttcaattaatggcctgttaaatacaattttctatattatatagaacaaaacgactcgactattaaatccctattaattcacccctccaaagttggaatctaggccatataaaagcaaaaaacctatcctgacctatattcagctcctagatcccggctagacggctagattttgcccgaattaatgcaaattatattccagtgtgtacgtaaacctacaattccagaattaaattttggatttgagttttgcttacaaaacacaagtgtttattaattgcattccggttgctggatttgtaattgttcagaagtcttttaggctctgaatacccgataccaaatatatatttaccaaagacttgtcatttatatcaaatatttttaccaaagacttgtactctaaaaaataccaaagactctaccaaagacttgtgtgtgtgttttgtggcgttgtggcgttgtgtggtggtgttctctctctgaacacgcatctctctctgagctcgcacattgtcttgtgctcgagc

SEQ ID NO: 3 - DNA, 5868 bp, Helicoverpa zea nudivirus 2
  source 1..5868: mol_type = genomic DNA
atgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggatgaggatgaggatgaacctatgcgtgaaacagagtgtgaaccagagtgtgaatctgagaatgaggctgaggatgaacttatgcgtgaacctgaacgtgaacctgaacgtgaatctgagaatgaggctgaggatgaatctgagagtgcctctgaacatgaatctaatcgtgaatctgagagtgaatctgagcgtgaatatgaatcggatgatgagggttccgaggacgaacgcgtagagcgtaacggttccaagtttgtagaatcggaatgtgttgaagatggctctgaacccgaatccgagtgtgaatgtgaatatcctgaatctgagcatgaggatgaatctcaacatgaggatgaggatgaatctcaacatgaggatgaatcggaacacgaatctcaacatgagaatacatctgattgtgagaatgaacctgaacatgagaatgcatctgatggtgagaatgaatcggaacatgagaatgcatctgagcgtgagaatgagaatgaatctgaacacgaggatatgtacgaggctgaaactgagccagaacaagaaccagaacccgagtcggtaccagaacagtttgtaccagaacagtcaatcccagaacagtctaccccaaacctagaacaaccaacatccactgtaaaatcaaacatcgagtctagtgtatcgtacaagcgttttctagagcgtatggactcgtctaatctcaactctcaaaagaactggagtagttattttgatgatacagtggaacagcgtgcgtccacttcaacacccaaaaagtccaagtctaaaaaacaaaagcgcatcaatgtcaccaagactagggtcgcggtaaaagagttggccaaatccaacaattggtccaagttgaaaaagctggtaaaagagtttaaagccatcgaggctaggcttgctgacattgatgactcggacgaggtgctcttgtgcaaactggagcgtaggcgcgaacgtatacttagaaaattcaaatcaaccagcggtgtcagcatcagggtgggtagtctgttggaaaagctaactatgaatctacccagacacttggtcgattaccgagaggccctagaggcgtgcatcctcaacaatagtcgtaaatcgttaaagttgccaactgtcgagactgtaaagcgtgccctgtgtttgtcacaaaacgatgcagttgaactgctcaagtgttgtatagagtcgttgcaaaagattaacggtagggatgaggatgatgatgatgatgttgacgaggccgatgaggatgctgatgttgaggatgagttgtag

SEQ ID NO: 4 - DNA, 2925 bp, Helicoverpa zea nudivirus 2
  source 1..2925: mol_type = genomic DNA
atgtattcttcccattctattctattcaactctactctttatactaacaaacttgcatttgctttaaacttactaacattcacactactcgatctgatattgactaaactaatgaatatctcttgtatgtttatagatggtgacgactcgggaaaggacaaagctggggacacggacaaggctggggacacgggtaaatctgtagagggaaagaataaaactctagagattatgaatcaaactatagagaccaagaataaaactgtagagggaaagaataaaactgtagagggaaagaacaaaactgtagagggtgagagcaaatccaaacctgccgaggataaaaccaaaccggcagaggataaagacaaggggaaagacaaggggacagacaagggcaaaggcaagggtaaaacgactgaggacgaggttgaatctgacgaggatattgacacagacgttgacactgactctgatgaagacgaatatactgaccatgatgaacgaaacaattcagctaaagcatttttgggcgcgtttgctgaatatgatgaggaggcggccaaatcggctgaggagaagcgcaaaaaggcaaaagagttggaacttgctgatgtacccaaagtgaaggatggtgagggttctaaagcaaaggatgaagctaaagcaaaggatgaatccaaggcaaaggcaactcctaaatcaacagagaagcctaaagcaaaggatgaatctaaagcaaaggcaactcctaaatcaacagagaagcctaaagcaaaggacgctcctaaatcaacagagaagcctaaagcaaaggacgctcctaaatcaacagcggaacctaaagcaaaggcaactcctaaatcaacagatgaagctaaagcaaaggaaactcctaaaccaaaggatggttctattcccagctcacttgtaccagattttgaaagtgagccagattacgaatcggatgaagacgagtcttccgagcacgaaataacttctacaacactattgaatgcgttcaacaaattggacgaagagagtcgtaaggaggctgctggtagcactggtactggtagcactggtactggtagctctggctccggtactggctctagtactggtggtggtggcaaatttgccaaacctacacccgattctagcacaccaggtaaagacaaacgagaggttgttagaatagacacggttggtgatgctggctctaaatctggtactaaacatgctgttgttaaatctgggattggtagctctggtaaaggctccgatactggctcgggcacacctaaagttgcagtagccgactctagtgttgaggatgaaatgtcagagggcgaagaggagactgatgaatttgatgaaacgagtgcggctgaggcagaaaaggctcggaaggttttacttgaacttgaaaaaggttctgttgctggaggcaaagctaaatctagtgatgtaggtggtgctaaagtagatgacaaaggaaaggaatcaaagagtcttggtaaaacagaggacaagggtgttaaagtagatgacaagggttctaaagcagagggcaagggtactaaagcagaggacaagggtgttaaagttgacaataaagaggaacctaaagtagatgataaaatagatgacgaatcagacgactctggtatggacattgatgaatctgatgaaacatctgaagaagaggcagaaaggaatcgtaaattgttaatgtctacatttgaaagtttggacaaggaaaagcctgaaaaagtcaaagttgacgacaaggcaaagactgatgaaaaagcaaaggccgatgccgcagcaaaagctaaagctgaggagaaggctaaagccgatgccgctgcaaaagccaaagctgatgaaaaagcaaaggctgaggcgaaggctaaagccgatgctgctgcaaaagccaaagctgatgaaaaagcaaaggctgaggcgaaggctaaagccgatgctgctgcaaaagccaaagctgagaaggctaaagccgatgaaaaagcaaaggccgatgctgctgcaaaagcaaaagccaaagctgaggagaaggcaaaggctgatgcggagaaggctaaagccgatgccgctgcaaaagccaaagctgaggagaaggcaaaggctgacaaggctaaagaatcaaaagaactagagtcaaaggataaaactgaaacacatgaagatgtaccagatgagttggacgagtcgggttatcatgaagatgaagagccaaccggtgtcgattacgaaaagagcaagcgtgcattcctaggtgattttgatagtggtagcagtggtagtggtagtggtagtggtgttggtactggtgttggtactggcacaggtacgggtaagagtactggtggtgctaaggatgaggttgatgctaaagagaaaactgaatccaagccagaaaccaaaccagaatccaaaactgaatctaaagcagaatccaaacctgaatctaaagcagaatccaaaccagaatccaaaacagacagcctagatgaactaatgcccgagtccgtcgatgcatcgctagatatcgaagagatcgatgcctccagtcacacagttgatcgtagctttgtcgatgcactagacggtatggatcatgaaaaagccaagacggcgctaccgtcaatgagtaaggttgatgatggtaaagtaaagaaacgcaagcggtcaaaggagattgatgatgttgtagatgcaaagaagacaaaggaagctagtggtaaactaatagttgatggtacactaaaagatgatgttgaaccaaaaactgatgttgaaccaaaagatgaggttaaatcaaaagaggacccaaaggacaaagctgaaccaaaggacgctgctaaagaaaaggagggtactaaaccaggtactcgtgcttaa

SEQ ID NO: 5 - DNA, 1941 bp, Helicoverpa zea nudivirus 2
  source 1..1941: mol_type = genomic DNA
atgcccaaagttgaatcgaaagtagtggtagaaactcctaaaattgtagaaccacctaaagcggaatctaaaacagtggaccctcctaaagctgaatctaaaacagtggaccctcctaaagcggaatctaaaacagtggatcctcccaaagcggaatctaaagtagtggtagaaacacctaaaacggtagaaccacctaaagcggaatctaaaacagtggaccctcctaaagttgaagttaaagtagtggatcctcctaaagttgaagttaaagtagtggatcctcctaaaactatagaaccaaccaagactgtagaaatgcccacaattgtagaaacacccacaattgtagaaacacccaatccttcaactcctcctgatttcgatgaaccatctatggaatcgttcgacgaaccgatggatgttgacgaggacgaaatagctccggcattcaatccattcaatgtagttgacaaagagcgcgaagaggttaaacgcaaagaggacgaagccaaacgtaaaaaggccgagtctgaagttgagatgcacaaagatcatgaaatgcactctagtgagtttgaacctccatccattgacgagtccgaggagaccgagactgacgagtacaaggctagtgcggctgcatttaagaatatgttcagcagcatggatgccggtgaaatgccagaatcgattcaacgcaaagatccaaaaattgtagatgttcaaccaaagactcaaccaactttaccaaaggttatagatgtacctcccaagactgtcgaacaacccaaacgtaaaaaagagccaaaacgcaaagaggaacctcccaagactaccgaacaacccaaacgtaaaaaagagcaaaaacgcaaagaggaacctccggtaattccaaaaactatcgaacaacccaaacgtaaagaggacccaataaaagaaacaccaaaggtggacgatggtgaagccaaacgtaaagccgatgctgaagcagcaaagcgcaaggcagatgcggacgccgccaaacgtaaagccgatgctgaagcagcaaagcgaaaggctgatgctgaagcagccgaagccaaacgtaaagccgaggctgaagctgctgccaaacgcaaagcggaggctgaagcagccgaacgaaaaagaattgcagatgaaatagcagccgaagccaaacgtaaagccgatgcggacgccgctaaacgtaaagccgaggcagaagcagcaaaacgcaaggctgatgctgaagctgctgccaaacgtaaagccgaggctgaagcggcagccaaactcaaagccgatgcggaagcagccgccaaacgaaaagcggaggctgaagcagccgaagccaaacgaaaagcggaggctgaggcagccgccaaacgtaaagctgagattgaagcagccgccaaacgtaaagcggaggctgaagctgctgaacgaaaaagaattgcagatgaactagccgccgctaaacgtaaagctgaggctgaggcagccaaacgaaaagcggaggctgaagctgctgaacgaaaaagaattgcagatgaactagccgccgctaaacgtaaagccgaggctgaagcagccgctaaacgcaaagcggaggctgaggctgccgctaaacgcaaagcggaggctgaggctgccgctaaacgcaaagcggaggctgaggctgccgctaaacgtaaagccgaggctgaagctgccgctaaacgtaaagccgaggctgaagctgccgcgaaacgcaaagccgaggctgaagcagccgaacgaaaacgtatagaagatgaaaaacgtattgcagaggaaaaacgtattgcagaggaaaagcgtattagagatgaactagccgccgaagccaaacgtaaagccgacgaggaagcgaaacgtaaaatcgaatcaggtgaatttaaactccacagtcgaatctaa

SEQ ID NO: 6 - DNA, 2966 bp, Helicoverpa zea nudivirus 2
  source 1..2966: mol_type = genomic DNA
cagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacaagagacttgatggaacacttatatgtagaacagtactactactagaggatagcatttagtagaggtgctgggaacaatagtgtgccgagtataatcataggtatgtgttgcaatacttttttctttatgcttttacattttacgattcattacttgacactgattgatattttatacttgttgatattgtgtggataatttatgaccatctgtgggaatctaggtaggtagggttttatacatgcttacacatacacactgacactgacacacattttacaaacaaacaaaacaaaacaaaagtacattaaaacaaacggaaaaccaataccatacattctatcattctatccttctactactattactactaccactatctactatgggtacctaccaaacattttttaaaaacatttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggttcggttagatataaggctcggttagctataagtcggtgcggctagtttatataagtccggttagatttaagtacggctagtgtataagtcggtgtgagcacaaatcaatagatgtagtaagatgtgatgctttatgaattgaattttatgaattgatacacggacggtaaacaagagttgatttgtgtagtatacgtcttcttcttcctacttcctactattgtaaacaatataaaactaccaaatataaaaccaaacatttgtataaaataacaacacgggttgtacacatttacacatacacactatacacaccaatttagggttatgataatttaggacatttaggataatgacaaagtgtctctggtaaagactggtggtaagactggcaaatactggtatataaatgcaaggatacaactactgtaggtaggtactctgcaactattatactctggtatactcggcaaactttgtgtactctagtactctgataaagctatactctggtaaatattctggtagaactctgtactctgatatactctggtagacttttgtacatatacaactacaacaacaaatctggtaactcggtgactctgactctggcgtctcttggtaactctggtggtattggtattggttgataaaggtatcaacggtttcaaacaaaggtattggtatcaaataacggcatcaaaggtattacacaaaggtattaaacaaaggtattaaacaaaaggtacaaacaataggtttaggcaaatgcacacacataagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgcgatgcgatcgttaggctctgtgtacgagtatcgcatcgcacaacaacccactgaccaaccccctcgcaccgtcacgttgtctttcaggcagtctctcgtggcgtgtgcgcttgtttgctttgcaaagagattgccttagtgccttgttgcaaccatggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgac

SEQ ID NO: 7 - DNA, 3020 bp, Helicoverpa zea nudivirus 2
  source 1..3020: mol_type = genomic DNA
cacgatccgcacccgatgtatcgttgaggctcttgactagatttaagagtttttcaatgtcttgatttttggtagtactagtactagtactagtactaggcttggtaggctttggtttagatttcatcatagcatcatcaaatcgtacaattttaacattgtcagccattggtatagtgttgggactcctcttgcttctgtggttcactcggttcattgtttccaaatcgctcacggtcacatctatgggcggtagtttaaaattgggatcgatgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgctagtctctgaccaacggtagcgaacgttgtgtggcttgtcggtaccgtcatcggtgtgcacggccgtttcgaacaagtggaagcaggccggattgcattgaacctcaaagttttcactctcacccaatctatagtagctggccgcatccgtctttttgcagggtccgtgcacaccggacgagttgcacgaaatgctctcgcacaattgttttgtaatctctgcctctacgaatatggcctcggaggccattgccggtggaatgtaataatcggcatcggtggccgctctgacgttgactttcaagtgcgacgccaagaagggatacttttcgttgagcttgtgcagtagcatcaagagtttacgatggtacgaaaacttggaggcatttgcaatgtctaattgggtgtaggttgtggtggtagtggtagtggtagtagggtttgttggtgttgtaggattaggattagggttaaggttagtaggtacagtagacattgttggttgtgtggattcattaacctagcatatacatacacacaaacgtgatatttatacaaagatttatacctaatatttattaagtactcgataagtacaaagattcaagtacctagtactactatggggaacgtgcacacacagactctctcttccttttgaaggaatttaaactttttgtacaataaaattaacaagcaagattaatatgcaaatagcaataacgtgcaggttaatatgcaaattttaatgaggagttcaacttatgagacttttatgacaatatcaagttttgtaaataaaaggttattttcaactgcaacaatgtgtgatgcaaatttgagtttgtacagagtagctctattaaaaaagaatactgcaagcgttgttcattttatacacaacttgtcatatacgagtactagtaacactactagtaccactactacaactagtacaactagtactacaacccatcatagaggtttaccaattcttgtaatctttcaatcttgtaatataaactaaaactaaatattcttacattaccaattctctttacaataccaattcttacaataccaatcatcattatacaataccaattcttacaataccaattcttacaataccaatcatccttacaattattacaactgccaattatagctctatgtagctctaccaccagctactacagtctacactctacacgctctactacatgatccagtacatgctccactctacacactacggcactcggcacgctccactcgacacactctactctacatactcttatcctaatactcttacaaatatttaaacaacaaataacaagcaatagcaacaacataggcggactttaagactttactgtaaactaggatgttcagactactttgataaactaggactttaaaacaaattgatacattataataaaagtacaacaaaagtacaacaacccactacctcccttcaaacaccaaatcccttggatctttacaagtactttaaatttccaaacattttagatccatgattaaagtacaagtctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagccgcaaccgcttcaagtgtccgattacgtgaccggggtctccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtacagcttgataatgtgagagatgagcgcttcgctagtgggaaactcttcgccgtttacatagtctacgtacaagttttgctggatcaggtagtcgacgttttcaaagtagactagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgc

SEQ ID NO: 8 - DNA, 4838 bp, Helicoverpa zea nudivirus 2
  source 1..4838: mol_type = genomic DNA
taatagctttagccaccctgctgtacgtacattttcctgtttattcagtcagtgtacggactctgtgcggataaatactgttattctccgagttttggagtttttattctgaaattccaactcggtaaaaatcacaagtctgtgctacaactctagtacaagtgctaaactctgatactagtgattggctccaacactagtgaccaaactttaccaagtgattgactctgatactagtgatttacacaagtgttcaactctcctctacaatcatgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggat

SEQ ID NO: 9 - DNA, 1392 bp, Helicoverpa zea nudivirus 2
  source 1..1392: mol_type = genomic DNA
atgcacggtaaaaaaggcgccaaagagaactttgatgattctagtgaaattgttagcaaaaaagcaatgaagatgggtatagggtttggcgttgatgatgatggttatgagaatatatcagactcggactctgagtctagtgtagaaacggttgctagtccgcccagtattgaaaaggaggttattgttgaaaaggaggttattgaaaaggatgttgttgaaaaggaggttatcgaaaaggttgttattgaaaaggaaaaggatggtattgaaaaggaggttgttgaagaaaaggatgttattgaaaaagaggttattgaaaaagaggttattgaaaaagaggttattgaaaaggaggttattgaagaaaaggatgttattgaaaagagtagtgtagcatcaagtgttgaaactggtggtactataccaagcactgaaaaggcaacaaatccacccaccattgaaaagacggttccagcaacggtgctagaccctacactagttatggaagtggatgaggatgacgatgactatttagaggcagaaccaatggatgtagatatcgagtccgagcctgaacccaagagtgaatcggttccaaaggatggttctgtagagacaatgaaggatagcactttagagccaaaagaggtaaaggttgtaagtccagttatagattcaaaggaaaagactgtagatgagaaatctgaaatgcatgtagattcaactgtaggtaaatctgtagtggtttcagagccaaaagtagtcgatgtcaaggtagatgctaagggtgatcctaaattagattccaaagttggtaaattggatgataaatcggaggcaaaaactgaacctaaaaccgatgctaaaattaatataaaaacaattgaccctaaagtagatggtagcgttgaaacaaaggcagagcccaaattagacaaagtggatgataaatctaaagatgaggttatgccagaaagtaggccagaacttaaaccagaaagcaagccagaaattataccagagagtaagttagaaactaagccagagagtaggccagaaattataccagagagcaagtcggaagctaaaccagagagtaggccagaaattataccagagagcaagtcggaagctaaaccagagagtaagccagaaattaaatcagagagcaagtcggaagctaaaccagaaagcaagacagaaactataccagagagtaggccagaaattataccagagagcaaggcagaaactaaaattgaccctaaagttgaatccaaagaatccaaacctaaagatgcccctaaagtagagctatccaaagctgaacccaaggtagttgaaaacctaaaactgatcctcctaaagatgatccagaaccaaaagtag

SEQ ID NO: 10 - DNA, 25 bp, synthetic construct
  misc_feature 1..25: note = Primer
  source 1..25: mol_type = other DNA
gtggtgccagactttcagacatcat

SEQ ID NO: 11 - DNA, 25 bp, synthetic construct
  misc_feature 1..25: note = Primer
  source 1..25: mol_type = other DNA
gggtctgttgcgacctaaaggtcta

SEQ ID NO: 12 - DNA, 24 bp, synthetic construct
  misc_feature 1..24: note = Primer
  source 1..24: mol_type = other DNA
cgaagagctcttcactggcgtggt

SEQ ID NO: 13 - DNA, 24 bp, synthetic construct
  misc_feature 1..24: note = Primer
  source 1..24: mol_type = other DNA
ggtgttttgctggtaatgatccgc

SEQ ID NO: 14 - DNA, 24 bp, Helicoverpa zea nudivirus 2
  source 1..24: mol_type = genomic DNA
atgaagctgaggatgaatctgaac

SEQ ID NO: 15 - DNA, 36 bp, Helicoverpa zea nudivirus 2
  source 1..36: mol_type = genomic DNA
gaaactcctaaatcaaaggatgaacctaaagcaaag

SEQ ID NO: 16 - DNA, 60 bp, Helicoverpa zea nudivirus 2
  source 1..60: mol_type = genomic DNA
atgaaaaagcaaaggctgaggcgaaggctaaagccgatgctgctgcaaaagccaaagctg

SEQ ID NO: 17 - DNA, 24 bp, Helicoverpa zea nudivirus 2
  source 1..24: mol_type = genomic DNA
ttataccagagagcaagccagaaa

SEQ ID NO: 18 - DNA, 81 bp, Helicoverpa zea nudivirus 2
  source 1..81: mol_type = genomic DNA
acctaaagttgaatctaaagtagtggaaccacctaaagcggaatctaaaacagtggaagctcctactaaaacagttgaagt

SEQ ID NO: 19 - DNA, 30 bp, Helicoverpa zea nudivirus 2
  source 1..30: mol_type = genomic DNA
agctgccgctaaacgcaaagccgaggctga

SEQ ID NO: 20 - DNA, 231768 bp, Heliothis virescens nudivirus
  source 1..231768: mol_type = genomic DNA
gtgctctaaaatgtcaatttgcatctcaaagactgcaaacttgtatgccttaaaatggtgccattaccgtgtctagttttgtactttgggctttacttttgggctttactttagacgttaagatactcgatttagatactattcttgtcacaagtgaaactaatgtcacaagtgaatgtcaaactaatatcacaagtgaaactaatgtcacaagtgaatatcacaagtgtacagtacaaatgtattagcgttaagatcgaaccgagtatggttatttagatgtaagtagtaggtagtaggtagtaggtagtaggtagtaggtacctagtaagtaatgtagtagtacgctagttggtcggtattctagttgtttagtacgctagttgtttagtatgctagttgtttagtattctagttggccagtatactagttaaattcaactattgatttaatttaaattataaagttactgttgaagaggtagtgtttaagagttttgttgaagaattattgtttaagaattactgttgaagtaaagttactattgaagagttactattgaagtagatttaagaattgtgtgccacctatgaaaaagactatacttgcccatctattttatagaaatgtattttagagtatttttagagtattttagagtcaagtttatattagtattttaaagttaactatatttagatttaaatacctagtagagttatatacaaatgtcaaatatcaacaagatgaaatatcaacaagataataaagtgtttacaacaatcaatcagacttgtatcatttaaagcatccaatcattatatccaatcattgtatccaatcattcaagcaacccattaccagattgcctcccagactaccattcacttggctaaagtgtcaattgccgtctttcattgaactcgcacatattgccataataatactacctacccactttaatccctctctcactctaaggtcaaacctcaggcaaattgctcaggtctcagatctcagtctcagttctcgggttttgtttagagttgtatagttggcagttgcctttgtttataatttatatcgttgtttataccaagtctcgccatacacacacttttcataggtactcttcacaagtacttctcagtactagttgggcactctccatagaggaagcgtgtgtatattgtttatatgatactagtttatatgatggtttgtttatatgatggttgactggtagtgataccactggtggtgataccaaatgaatttattatataaacattgtgtgtgtcatcaaaacagtgtgtctgtcatctttaggtagtgtatcaatctctatgttgactgtatgtacttgatgatttgtacttgactgtatggactgtacttgtacttggttgtatgcattgaatcggtataggattgtattgaatatgtaaaggtctgtattgaatctgcatagcgagactctttgctagcacgactcctagcactaccatctaatggtagcctacatccctaactaggcaaatcatgatttgtttgacatcatgattttagagtgaaggcactctggcaaaaatgtaaacaaacacaagtagggatcaaggtttataggaatcagtaaaataccaaggatacagtttacacatgcatttattgaggtttatttataggggtttattatacagtgtacatttatggtttgaaataaaatgtaaaacatgattaaaattacacttgtaaaataacgggtatatttagtataaatggaatggtatacaagagtgtgtctttaaataataagtgtctttaataaaatgtttagtttatctaaatatagattctttattacatctaaatacaaggtttaaatataaagtctaaatataatggctctatataattcctctataatctacatatttcctctatacaaagaatacaaaagtacaaaaaaagagtattaaaagagtaggtaggtaggtaatacaaaagagtataaaaatacaaaaggttacaaaaatataaaaagagtacaaaatacaaaagagtacaaaaagaacaactaaatagaaccaaagttcctccaaacataaaacataaatcaaaaaacaataatctactcatgtatacaacgagtcaaacatggcgtggtaaaggttgaccgtgtcggtcatctttacaccaatcatgctcttgaaatctttggccattaaagttttacgacccgagtttaacattacaatataggccgcctccaataaccgagccagatagcactcggtcacgtctcgcatcaacaacagagcctggcccctgtatcggagatgtacaacttggtaagagtcgatctgaatttcgatattcttccaggcacgacaaaaaggcaaagtcggtatgaattgcattttacacgatttggacttgatcaatttaatcatgtatgccacatcaaacttttcatcttttgcactgccaggatccctaccctcgtaatcgtaatcgtctgccaatacacgcaaacctacagactttagaatagatttaatgtcacgaatctctacagtcttgcgcttaccgcactcgaccagcaaagtcacacgacgctttacctccttcatgaaaaactctatgattctactcagctctggatagacatcctttgagattctatctatgcccaatcgttcagcaaaacgtctgataatgttcttgtttataaagttgatactttgagactttttaagacgctctgcacgcatggcggcaattctactaccgccaccggcttcactagagattttatgaatacgcggcaccttggtggcaatgggcagagttctaactgtgggcacattggcgggagcctttacaaaaaggtatttacgctgttgttccctcttgtcaattttggacttggcggcatcatcggtggatggggatttgtatggagaggccggggttttgggagctggagattcgggtacagagtttgaattgtttgcattgggtgtggatggttcagtgtttgttgtaggtgtagatggtacagtgttggattcagaggttgatggtgcaggactatttgttataggtgtggatggttcaatgtttgttggaggtgtagatggttcaatgtttgttgtaggtgtaggtgtagatggctcagtgttggattcaaaggttgatggagcagggcttggtgtaaatgtagagggagttgctttaggtttggaactgggcttgggtttgggtgcagagtttgctttagatttagacttggctgcatcagttttaggtttaggtttgggatcagatttagacttggaaacggtttcggttgtttcagtgtccgagtcttgatcgtcagaaatgaactctttggacttgtatttcttggaacgtttggatttagaattggatatggtcttgtacggcaatggaacggttggtatagggataccgttagagtctactctaggagtggtgggttgtttaaaaataatggtaacattttgatttggagtgttggttggaggtttggatttcgggttgggtttcggtttcggtttgggtttgggttttgcagcagattgtttaggagcaataggtttaggaatagtagtagtttgtttaggaacactagttggttgtttaggatcaggtttaggagacttgggtgcaggcttggtgttttcaacagaagaagcaacaacagtagagttggactttatcgttttgggattggatgtctcctttgcattggatgtctcctttacattggatggctcttcatcctcagagtccgagctaccactactatcattgtcgctactaccactatcctcgctaccactactctcttcatcgctgctgtccgaatccgactctggtgccggtgatttggattgagtggggttaatctgtttggcagtctcagagtttgattcggacgcattgggtgggttagagtttacactagcagaacctacatttcctacagtattggcagaatccttctcaacctctttgtgcaaattttccattgagcgttctacatcagagccaatgtttgacaagttgatgggtacattggacatggatgtattagatgatgcattcgatgctgcatattcttttgttgcagcatttacattgttgttggactctactacactagttgcatttacattgacagttgttacagactccaccgaaccgtttacatcgtcaatctccatagcagcgttggacgcgatcgattctacacccgagtcaaattgcgcattagactctacgctattggccgcagtgtcgtaagtctgatagcccttgtttgcagtgtgatcaaacttgacatactttttgtgtctgtattcagatggtttattttgaataatgggtttgatcacagtcgcatcctgagctgcagacttggcctgatctactaccggtttaactgtaacaatgttgttgtgtgcgtttaatggacgagtgttaaaagatgaaacactgccgctactagcagtggtagcagttgcgctagcgctactagtattggcaatggtgaatgtattacctgccgactctgctgcggtagtagagcgcgtaaccatagtcttgatgccggccgaaccactacgtaacactttaccgccgccgatattctccttttcatgtgtacgtttacgactctgcattttggacacgtcaacgatctcgtattgagtgtttaataaaccaatttctagttctgtgttgccttgacctgaatttataacctctttgcgcgggaactcgacacgtactgaatttagcgcctctcccttctcctgcgcacgcgggcgtttacctactacagtagtcatgacactattgtcgtctaatatggaagtgtacgtagtcttgttgttattgttattattattataattgctgtaatctacacattggtcctcgtcatcggtttcgataccgctacgtttaggagtgccgtccgcgtttatacgtttaccgatagatggagccgccctaggggtatctttaaagtttaaaaaggtcctcataaatttaagcttgtcctcttcgagttccattgcatgttgcatgtcgggagtcggagtgtttagcgtgtctctataaacaaaagatgatggattgtttgacatctctgcttgattgttgttggcaacatcaaacacgggaatttcaaaacccaagtcatgcatcgtaatgttgggagcagcagtattgccgagttcatgagcaatgttagtattggtggttggaatgggaaagattgtagtaccaggaaagatggttgcggtgtcgggcatcatcggattgaaattgtacccatagccgttgggataagcgtttggatacatcaagttgttgtatgcaaactcgggttgttgatagtactggggatcagttttagaacggggacttttaccggtaggattcatgcttacaagcttctacttctacttgctactaacaccagttgttacaattacagtacactaagagtaaataaacaataagagtaaatttacaattgcagtacactaagagtaaatgaaaagagtacacaaggataaatgaataaagagtaaagtaaaatagtaaagtaatacaagtaatacaataataaaatagagttaaataacaagagtaactgggatgcaactaaaactacaaactataatgcaagtcctaaaatacaataacatgcaaattaaaactaagatgcaaagtaaaactaaaatgcaaaccaactctaactctatactacaaaaaacactagtctagtatacagcagccgcagtagagtcccttgtagcagcagtagatgcactagatgcagagtgcaaaacgccagtatacgccactagcaaacaaacactacaccagcatacaccacaccaacacagcaggcagagttcagagatgtgtaattaagtcacctggttactttactggtaaaagtgcacaccagagtacgagtcgctcagagcaaccggtagagtagcaccacagtgcagtgtagaacagggcaggagcaagtctcgagctcgagcacaaggcaatgtgcgagctcagagagagatgcgtgttcagagagagaacaccaccacacaacgccacaacgccacaaaacacacacacaagtctttggtagagtctttggtattttttagagtacaagtctttggtaaaaatatttgatataaatgacaagtctttggtaaatatatttggtatcgggtattcagagcctaaaagacttctgaacaattacaaatccagcaaccggaatgcaattaataaacacttgtgttttgtaagcaaaactcaaatccaaaatttaattctggaattgtaggtttacgtacacactggaatataatttgcattaattcgggcaaaatctagccgtctagccgggatctaggagctgaatataggtcaggataggttttttgcttttatatggcctagattccaactttggaggggtgaattaatagggatttaatagtcgagtcgttttgtatatacatatatagaaaattgtatttaacaggccattaattgaactttaacagcaatttaacattaatttaacagcaattttaatatgttccagatacctaccgtacgcccactgaaaattcttcatataaatacgataatggtaggtgttggctacataatagctttagccaccctgctgtacgtacattttcctgtttattcagtcagtgtacggactctgtgcggataaatactgttattctccgagttttggagttttaattctgaaattccaactcggaaaaaatcacaagtctgtgctacaactctagtacaagtgccaactctgatactagtgattggctccaacactagtgaacaaactttaccaagtgattgactctgatactagtgatttacacaagtgttcaactctcctctacaatcatgtctaccggtgctcttggactagacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgcttcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccgccatggtcatcaaagagtacgagattactgtagatttaaagtgtctgctcaaaagcaaattgttgaattgtctaactctgctcggggacgggtacgctcccattagaatcattcagtcctttaacgagacctttttcgatatgaacattaacgatgacgatcacaacaattggcgtttgagcagagagtatgtatgtgctaggaacctgcgtgaaaagatctctaccgactcgacctttctgaactttgccaacattagcagtgccaatatgatgctcttgtggaacgagatgcaggccgacattcagtctgccaccaagcaaccagcaaagagtgccgagtccattttgcatccgtttgttcagccacagatgcagcagccgccgccgtcggtggttagttcgtattttgtaaacacttgtaccaacattgctgccaatgctggcactggttcaggaggtggtgtcggtggttctagtgattgctctaaggatgctaatgctagtactagtggtgtcagttctagcaaagctgttgataatgtaaactctagtgttaatactggtgtaaactctagttctgatgcgagttctgatgcaagttccaaggtaagcaacagttctggttccaaccgttctggttccaacaatggttctggtaaaaacagttctggtaaaaacaccaacagcggttatacacctagcgactacaagtacgattgcggtagagacataagggttggcgaggacgaagaggacagcgacgatgaggtaatgtccatttcatccgctcggtctagggctagggttataatgagtagtagcagcagtagtagcagcagcagtgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctggctctaaacattcaagctctaagatttcaagcaactctaaacagtcctccaactctaagcattcctccagctctaagcattcctctaaacaccactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacacccaagcctgcttcaacttcaaatcctacacccaaacctgtttcaacttcaaatcctacacccaagcctgcttcaaatcctacgcccaagcctgcttccaagcccgagtctgtttctaaacaaccaacttcatccaagcctacttcatccaaacctgcttctaagcccgagtctgtttctaaacaaccaacaccatccaaacctacttcatcaaaacctacatccaaacctgcttctaaacccgagtctgtttctaaacaaccaacttcatccaagcctacatccaagcctacttcaacactaaccaaacctacatccaagcctactaaacccgattctatttctaaacaaccaacatcatccaaaccctctgaaaagccatcagacaagactactaatactactaccactgctaacactacgcctgtttctaaaccaactttatccaaacctacaccaccaacaacatcctcatccaagcctgctccatcatctaactcaacctctaactcaacctctaaatctacatcaaaaccaacatcaaaaccaacctctaaacatacatccaaacctacatcaaaatccaacacttcaactgccgcaacctcaacctcaacctcaacctcaacctcatcctcatcctcatctaaccgattaacaaccgcccaaatcctagatatgattttaagccactacctaaacggagagattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttgcagtagagactccatccgagtctacatctaatgtaaatgctgagtcggcatctaatgtaaatgagccacagccacagcaaactgagccaatggcaaccgagccagtggcgaccgagcccatggacattgagactgcttacatttccgactctgagtacgaatctgatgttccaactgtagagactaatgaccatacaaatgtagagattactgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgataacaataccaacaatcccaacaatactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggagccacctggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccagtcatagacatgggggccgcatctcctgacacggccgatatttcatgggaggacgagttgtacatttctgacgagggcgaggagggtgactgtgatggttctaaaccatcaacatccaaaccctctaaaccatctagccctagccaaccttccaatgaatctaccagtaaacctaaaactgttcaaactaaaatcactcaattcaccattgactttgaactggaaaaatccaactcgtcctctgtcccatctgacgatgtcgataaagccagaaagattctatctgacagtgagtttgattctgaagttgagaatttcaatgacaagcagcaggctcagagcgtttctagcgacagtgttgtagatgtaactatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctaggttggatgatggtgttggtaataatgttggtagtaatgttgatagtaatgttagcgagtgtgttgatgaggagaatgttgctacgagtgttgttgagagtaatgaaaatgagaagcatgttagcgagattgaatctgagaatgaggatgaggatgaggatgaacctatgcgtgaaacagagtgtgacccagagtgtgaatctgagaatgaagttgaggatgaccctatgcgtgaacctgaacgtgaatctgagaatgaggttgaggatgaacttatgcgtgaacctgaacgtgaatctgagaatgaggctgaggatgaatctgagagtgactcggaacatgaatctaatcgtgaatccgagagtgaatctgagcgtgaatatgaatcggacgatgagggttccgaggacgaacgcgtagagcgtaacggttccaagtttgtagaatcggaatgtgttgaagatggctctgaacccgaatccgagtgtgaatgtgaatatcctgaatctgagcacgaggatgaatctcaacatgaggatgagtcggaacatgaatctcaacatgaggatgagtcggaacacgaatctcaacatgagaatgcatctgattgtgagaatgaatctgaacacgagaatgcatctgagcgtgagaatgaatctgaacacgaggatatgcatgaggctgaaactgagccagaacaagaaccagaacagtcaatcccagaacagtcaaccccaaacctagaacaaccaacatccactgtaaactcaaacatcgagtctagtgtatcgtacaagcgttttctagagcgtatggactcatctaatctcaactctcaaaagaattggagtagttattttgatgatacagtggaacagcgtgcgtccacttcaacacccaaaaagtccaagtctaaaaaacaaaagcgcatcaatgtcaccaagactagggtcgctgtaaaagagttggccaaatccaacaattggtccaagctgaaaaagctggtaaaagagtttaaagccatcgaggctaggcttgctgacattgatgactcggacgaggtgctcttgtgcaaactggaacgtaggcgcgaacgtatacttagaaaattcaaatcaaccagcggtgtcagcatcagggtgggtagtctgttggaaaagctaactatgaatctgcccaggcacttggtcgattaccgagaggccctagaggcgtgcatcctcaacaatagtcgtaaatcgttaaagttgccaactgtcgagactgtaaagcgtgccctgtgtttgtcacaaaatgatgcagttgaactgctcaagtgttgtatagagtcgttgcaaaagattaacggtagggatgaggatgatgatgatgatgttgatgaggcagatgaggatgctgatgttgaggatgagttgtagtttaatgtttatagttgtaagaaagaattgtaatgtatatagatgtaagaaattgcaatgtatatagttgtaagaaataattgcaagaattgtaagaacaaatattgaacaaatgtagctttaaggattgtttattgattatgttatacattaaatgtaaactctaaactgtggtgttttataaactgtgttattatattattacattattttacattatttgttattatattattatatcattttatgttattctatgaaaataaatattagttgaactaccaacttgtgatttcatttatacattgatttatacattcattcatacccttcatatatacccttcatttataccaaagttatacaaaagttagggaacctagctaaaccaaagtcggaggctcatacaaattagggaaactagctaaaccaaagtcggaggctctatacatacaaacataccctaccctctgtaggagagcaccaactctgtgtaaacacactgagctcaaaatgtgccacttttgcatatacacccagtgtatactttattgaaaattacaaatttattttcaatgaatcaaccctgtaataagacatgttgcttgttaagcgcagtgtgcatcccctatacgtcatgtcaaatttggtacttttgaatcgtccagtgtcagtcgagaacggtgcaatcaacgccaacgaactggcagaggttctgggtttcgatcgacacttgatggtcgaacacgtagacgacgcctaccaaaacttgaaagatgacgaaaccgacactctgtacattacacgcactggatttctacagatcctggctgcaatgcaccacactaccaagcactctgacctggcccgtcgtctgaccgaatccaaagaggttctctcctggatgggcttcactcgtaaacagatggagtgcactctgaacgtgcacaagattaattatcgcagccgactaacgttcggtgccatggctcgattctgtagactggtcaaccagggctttgcctatgcctacctgtgctaccctaaagacttgtgcctctttgacagtcccgagagacgcataatcgacaaacccatcaagtatagtgtgcccaaagaggacgacgctctgatcatgatcgacaacctaaaggtggcagtgtttctgcaaccgtttacacagctcgaactgcaagagtacagagccatagccgaggcaaagggctacactctgatgacgctaaccatacgaggtccggccaagttgttgggggttttgatttacaagttgttaaatgtgtagaatgggagagagatgtagagaggtagagtgggtatagatatacacatgacctaaaggttcatcacaaagagtgccatattagatgttagctgttagattagttagttgcaaaatattttaatcatttacaaatggttatatttaaacaacactattttgagcaagtgttgtattctattgtattgaactggaatgaaatgaactgaaagaaattgaatctgtgttacatctatttttattttttagcatcaatgtatctattgttgtattgttacattgtcacttgctacttgttattgtcacttgctacttgttattatcacttgatactatacacccactttaaagactcgtagcacgtgtacaatattctaaattcagagtatagtgttccaaaattcagagtataatattccaaaattcaaactatactattccaaaattcaaagcagaatatcacaaaatttaaagtacagtatcacaaaatttaaaacactgatttaagtatgccatcacaaaatacagaattcaacattacaaaattcagagtacaatatcgcaaaatgcaaaactgagcatctcaaaattcaatgcaaaattcgaggttttaatgttgtaaattggattatgaaatatctcaaattttaagccattaaaccgcagtctgtatattgactataaatcatcatgaaattcaatctggagtttcacaaaattcaatctatacggtcgtaaaagagagtttttggtactaaaaatgcctgtgccggttcaagtaaaaatacagaatcaaaggtctagaagttgactcgtgtaaaattgaatccgttcaatttccactcgggtgttggaaacgtgattgctttgctgctgcgtaaccaatacacacacattacaagaacaattctagattgtgtaaattacctctggcttcatcgaatgccaagacactttttgatttacaagagtaggttgatttacaagagtacctagtttgatttacaagagtaggttgatttacaagagtaggttgtgttgggaataaaagacatttgaatatataggaactttgtttatttcaagtttagtacaaatcacattggtcacatctagctgtatgtttgcttgcatactctttaatatttacaaaatctcttactttttaaaatatctacaattctaatatttacaattctactacacccttacatgtctatcacatctactatatacaatcatatacactcttatacactaatttatacactaatatatacagtacaatttacaagtcaaaatatacaatatacaacactaaaaaactaaaactaccaccaactctaacgtcaactccaacgtcaactccaactttaacctcagtctctaactctctctaatctctaaacatcaaagtttaaaccaacaccatagtaggtctccacctccaccgagtgatgtactttaatccgcttgatggtaccctcttggtgctcctttatgtggcgtttgcgacacttttccaagtacgaaaccagctcgggttgtttgaccaaacgattccggacaaagtgtctgggcttcatttcagtgtacaactggccagagaaacgaaacgccaactttcccaagattacatactcgggtaccttgtagtctaccaggctcgacttgagcggtgtctcccaccgatccatcaggtcaaagtaggtcctacgaggcacgctgtacatgtactccaactgagtgcactcgtcgaacgtgtacagacaccgaatgttgctgcgcacattcataccaatctggtagagtttgtgcaacaggtaatggaacacttcagccttgcgcagttcagcaaacatgcattcaccgctacggatcgaagccaggcccgattcgatgcacggacagccaacgtagtcgaccagccggtccatttcgcgctgatcgtactcggacggcaccagaatgaacccgctgccgatgtagtctcgagagtcgcaaaagttgtgcatcatagtggcatacctccaacccttgggcagagtttgtaccgccttgatgtcttcgaccaccggtttgggcaattgctccaaagacttggccgaactgagtttggcactcttgatgacgcgcagaatggccaactggtagagggatggagggcacatggttggggctactaggatgatgctagacctttgatgataattactagaccagtgctgctccgagggttgcagtacacagaatgatgagcttatctgcaattgcaagtttatatactccaaccaccggatgttgaaaacgtgtccgtttaaaaaataccatgattcacaaaacagtcatgcataggaaaaagctttacagctacctataaagtgagtatgcaattatggataatacgctattggtggtataagaagcacgactattgtagaatacactctggtgtgcgcgcatttctaaacattcaaacatgctactattcagaggcatttcctagacacttgaaagttggggctttgcatttccgagttgttctagttttttagactgattcagcctcctactcttttaggtgctaggggttctagttttttagaagactagtgattctagttttttagactcggtatttggcaaatgttgtagctctgtgcattcaagtactggtagttttgggatgcttagaatcaaataaaactaaaaagttcgtgcattcgtttattatatagatggaagaacaatacaaattcaaacagtagttcaacattcacaatagtggagcatcctactggtttctactctatcctatctgttctactctagcctatccattctactttatccattctgttctatccattctactctaccctatccattctactctgatctagtctagtttacatacactacaacacctcttcaagcaacacctccatcaaaccattctaacaatgagtctcttgcgaaaaccaacatcagagaccgagtttgatttggaagatttaaccattagtctttcagactaccctttgagcaatcacagcatagtcgatgatattcaacacttgatgggagacctctactaccagtgcaacgactcgacgtgccgatgcaagattgaaataattgtcggcttcctgatgggcttcatactgggaagcgtactggccagattgacatctggctatgctgcaaatgcacaccactctcgacaagatcaaacagatgacgagggcttgggtacgagcaccgaagagggtgagaatgcggatgatgatgacgatgactacagtagtagtagcgaagaggccaccgactatggtgccagtaccgatgaggatgacgatgatgaaagtgcctcggaatggggcaacgaggtgcatttggattaagtagtgcaaaacaggggccactgtattgcacgacaaacatactgaccatgctagtagaacccaaaccagaatcggaatctacccgtaccaaagtttttcgttcaaaacaatctacaacaatctacaacaatctacaacaatctacaacactactacaaaacctcttgagaaaaatcaacctctgattttgaatcctacctccagaccacactatacaaaccaatctttaaatcaagagccataaacaaagcctacaatcagagccatagcctgcaatcaaggcctgtagtaaaatcctcacaaaacgtataatcaaatcacaaagcctacaatcaaaacacaacgtctacaattaaatcacaactcctacaatcaaagtacaactcctacaatcaaatcacaccaaacgaatcaaaaactgaatgcacgaaaagtatatgtgtacaatatatgctttggtgcaattatattactatgctactatgctactactacaagctgcaataaaagggtgccatagagtgtatagtttacaaaagtctagagagatatacacagagactggtgttagtaggaaaggaaaaatacaagtgcagtgtgcatttttaggtgtattgtaaaactgtctaaaacatgtgtgtgtagttgctaaatgtaaatactagatgtaagaatacatgcgagtgccctagatgtaagatactttagatgtaagatattctagatgtaagatgtcctaaatgtaaaatactttagatgtaaaatgtcctaaatgtaaaataccttagatgtaagatttaagtttacaattccaagtaggtacctaataaaaactttacaaaatataaaaatcttgttttttaaacacaaacaaatacaacacatgtaaacatgaatgttaaagaataaccatgaatagtaaagaatacacatacacattaaaaaacagtttaactaaatacattaaaaaatgcatccactctgcatctacataaaaacacggcaaacataaagataagactgatgcatcaatcaaacaagtttagtggcataatacatgataaactgtagacagggttcaaaccacactctctctataatatttctctcatctaatcctcgacgataatagttttattacccgacattagacgcggtatacagataaacttggcagtatcacagcccttgtgtttgtggtgtctgcgagttctagccagaggtttgacctcttccgtcatcgtagtagtgtttgcagtgtctccattgggcttgctgacaacggtggatgtagtgtttttgtgcagagttgtagggtcgtctttgtgctcgtcgtggtcgtcgattatggtggtcgtggtgttggtgcacggcttggcaaacagatgatggtgcaacaggtgacgcttgcttcgatgtgcctgtgaaaaaaagacgagcacctcgttatatactgatacaaactagggccactacaaacttgcacactaaaacaaacaagagtgcagaaaaggtgcataggatcataatcattattattgtaaggctactcagcgtttgctcttgctgatctataatgtactgttcgaccggattcggagagtgcactgccgtttgattctttatggtaggttttaatgggaatattggaatgaggctagtggtaccgttattaggttttctaatgggttttaaaaatatactcgtagggagagttggtttgtgtgtagtagagggaagcgttggattgtgtgtaatagagggaagcgttggattgtgtgtactagaggaaagagttgcattatgtgtactggagggcctagttggattgttggatagtgtaggtaatgtagcagtggttgtaaaagcatcatgtgtagtagtaaaatcatcacgtgtattagtaaaagtatcacgtatagtagtagtaaaaccatcatgtaaagtagtagccacctctggtacactagacaacaacagctctggtagaggttcaaaatgtggcacacctctttgcactgatgctacatcaacacttggctcgtcagattgtaacagagtcagagggttaaatttaaactttagtgttcccgattcaacatttggtagagcgtagccattaataatacttccaacgccgaccgatttagcatcgataaagtactcggaaatggacacattaaaaccgccaacagtggtcattattgaaacaaagggtactgtttcatttgtcgcaacaggaactcgttccagtgtaaagcgactgttgttataataatgaaaatgtttacattcggggtcaagagagctatcgggacattgttgattctcggaacgcttgaatagaaacgtttcagtgtttgatacgataagctcttgctgatgttttacagtgctggctttgttgttgttccaagtgtttagatagtgtatcaacaatggcaccaccacctctgaatgcgtataattgagaatgctacgcttgctatccaaacgccaattgtacagattgctccagtagccgtccagtgtgtcgaatcgactatcgttgccgttgaaggcaatcagcaccggcacagtggtggccggaaagggcacattgaaaaagtcaaaatccaacgcatctcgagcattgagaatgcacacggaaaagggcaagtttcgactgaggttgccctgcacaccggacgcgtccaactggaccagtacactggcatcggaggtttgaccgtgcagattcagagttgccgtctcggctcggtgcacggtacgcaccagtactctggcgtcgagacgtttcaacttgagcagcaaccgacgctcgatgcgtttactggccacggttgaattggtcaagtttaagcgtttggcaaactccaagacacgggcactcctaatgaccgaatcggtacacactgcctgttcgtttatggccgacaccgagtctgttttgtagggcagcgaagagtcggtgttgtacaagagcggcgagtcaaacattgtgactgtgcgtaccatcagacccttccaggcaagaatgtgcacaatgactgcaccgtatccgtagcccagtaggtttatcgattccgagtcaccgttgaaagcggcaatgttcctcttgacccactgtacggccagacgcacatcgtgcacgcccacattgctaggcgccaaatctcggtcaatgcacagaaagccaaacactgacaatcgatagtttacatggacaacgataaagtcggcatcggtaaagtgcgagtaccggtgtcgttcagagtgtgcatcgctcttgtaatagtctcgaccgtgcaccacgaccacgactcgaaacctactggcgacgaccgtaccctggggcttgtacacgttgagtgtgagacagtgttcggtgcccagagagtcgccctggatgcactcaatgtcagtgtctgcgtgcatagtgtcgtttggtgaagccctgtacagtttggcattgttgaacctacgaccgacaccatagggtatccctagaaaattgacagtattggttacctgatcatcttgtccgacgagacaaccggcgtcagttttatactcacaacaagtgcaacatttgacaaggacgacaaacagactgcataccagcaacaggtttgccatgttgctatagttgctgttggtagttgatgttgttgatggttgatatttctgatgtttgatattgctgatgtttgatactgatgggtgttactgattgttggtagatgtgtttctagcagacggtaaactgtaacacaaagggtgcttgtattaggaggatgcatcttgttttttaaacactattggtatactatttatactactttataatattatttaaaaatattatttaataatattatttaatattatttaaaatattattaaataaatatatatatgtatatttaagtaaagtaaaaagttgattaaaaaactacaacacgaacaactaggaatataaaacactagatattaaacattgaatacctactaaacatttacaaattaaacctttacaaattgaacctttacaaattaaccattgaaaattaaacatcaactctacactacaacaattcactcaggaataatgcacaaatacatatactcaagaatacgaatataagaatatcagaatataagaatataagaatacaagaatataaatacaagaatacaaatacctagcaattattattattcactacaaatgaaacccaagaacaagaggtacccaccaacggtaaaacaccaactgtggccgtctgattgtaaagcaaatctcggcctccttaaatagtagatgaccgattcatgtgcacatacatgtgtgtgcgataaggtagaggtgtacggtgagctataaactttacacacctagttttactcttaaaactcaggttcaacgcagtgggcatagtgctactattcagtcagtggaacactagggttattgtttctggcttttacattgtatgaatattatacacacaggcacatataatctagaaaaatcatgcatgatttatcacagcgtgtagtaattcgtcatggtcgtaaactaagaaaaccttcaatttgtacactattgtactacacttgtttgctaatgttgtgtaccataagctctcgctctagactttggcacacgcagcatacaccggatcggtcaccgttagcgtgttgattctctgctgcgtcttgggatggttgactttgatgtagtaccggtccgttgtctggggatccttgtggtcgagaatcattcgtgccacctctcgattctccacaacggtggctagattgtatcgaaacacgtgcagtccaaaacccggatacggtctgcacttgcacacggtcatgtagtagcgtttcagatggtagctcaccgtagacgtggactgattgaacaaaacatcatcgataccgtagcgctcaaacgcctccagttccctactgtaaaactcggacagtttacctagaaactcttcaaattgattaaagtagtagactcgccattcggtgccgtttttgcgcttcagcggtatcgttctgtctttgcgcaacaactgccacagatggctgactttgatgcgattcacctccaccgaacgcaaccctgtatagtaggctagtagtatgggatgcgtatagcgatcggtggacactagctctttgagtgccttgaccaacacttgaatgttttccgtgtccgggtcacggttctgaggtgggttgttcaaatcaaagaccatcggtgagacaaacactttggtctcgggccaaaagagcggtttcaatttcctaaagtagagcttgaacgtggaccatttgactttgcgcaagtacatttgacgcacaaaggccagtgctctatcgtcgtcgttgtcgtactgttccagatgcatcatggccacctgtttcattagcttgttaatgtacggcaaacgtttggcgtgcttaacgtaggccgcataggctttggcattgaccagtctgactcgtcgtcgtctgagtctgcgtggtctgtttcgattgttggcattgttgacgattccactagtattggcatcggtcatgtcatcgtctccgtggtacgtttcgtgggttgcttgagctacactttgctggagggatgtcatgttatgttgaagtttccggctctggctcacacaacggtgcaaacgtatgatacgtgtagaggataaagtcacgattcagaaaaggcatacacgccaaggttctgtgaagttccaactcttgttgaatccaattgttcttgtttagaattagaaatatgcacgttacaaaagtcaagagtagaattagaccatgcatcttagcatggtgtatgaatatgaatgaatatgaatatgtgtatcaaacaaaaagactaatctcttgttgaaaaaaattgatgattactttaacatttttacagtactagacatttatcaagtattattaattattaaacattgctaaatattaggaaactactaaatgcatctctaaatgaatctactaaatacacccactaagtattataataaacactcacacaaatcaggaacgatgctgctaccgagacttgagatttactctgtttacttttgtacactataccccgagacttgaggtttacttttgtacactatataagtgtatctatcagtgtggctcatattcatactcgtactcttactcttactctaacattaaatcagctgcaagtatagttggactttttaccagtatactttttaccagtacactttttaccattgcattaaactatacttgaccaaatcactacactctttacatctgagttcccctcctggagcccctgctgcggctgcgtgagcgagaacggctcctgctgcggctgcggcctctgccagatcgggcagtgctacggtttcccgaacgagagcgagaacgcgacctggatcgtgaccgtgagcgagatctacctctgggcctgcgcacctcgcagctttcgtcaatttgacaagtttcaagagtcattgtgaatagggcactctctaaactagacactgggtgcatacaacaccaatacggtattggcactatgcaccacaatagcaacactttacatgttacggaaatgtgccaaattcacacaatccgacagcgacagatcgaagcgtacactcagcgagtttagcgtcttgaagggtggttccgcttcggcaaaacccagtcggcacacgaaccattcgtggggttcgtcgtctacgaggatgcgagacgatttcacggtagccactcggtccagatcgtagcacagtgtggaaaatctaaagatgcactgcacactgaaaaagtgaacgtaaacgccttgtccattgtttatagcaaagtgcatgcgtatgcgttcattgttgccgtcgacgcctgatgttccgtaacacactgcgttaaacttgcaccggacgcaagattgctgttcgattgcccacagtcgagacggaaacaggtcgtctacgcacatggtcggattgtcatacttggacagggtcacttcgcattcgaatccctgcgagtctacgagacgccagtgttgacgctcgaatggaatcttgataatcttggtgcacatgttttccgacgctcgcttccgtatgattataccgttggcgtaaaagtcaaacttgtcgcatttgctctgaaactcgatcaattcagagctgtccttaaagttttctacgataaacaatcgaccggctcctttgaccttttggttgcgtatggaacgcctaatctttttcattagtgtgtcttgagtgcgtctagcctttacttttactttaggtttcagtgatgaggactcagagtcggtgtcagtgtcaggttcaggttcagagtcagattcagtatcagtaccagaactagagccagagtcggtatcggtaccatatgcacccgatccacattcagatgatctggaccttgttttacgttctgcctcagattttagttttatagaatccaagtgtaattgcaagtcttctcctggatcaatttcaatgtattcggtgccgtctgtggttgatggtgatgtatggtccttgtctttattctcagttgtacatgttgaattgttagtttttgtagaattactagaattgttagaattgttagagttactaaaattgctagaattgttagcatctacatcaacctcctcatcatcatcttccttgaagatatctcccccaaagggctcatccgaagtgtagcaatcggcaaatacacgtctggccacatccaagcgttcctcgtacgtattgtccagtatggatttaccattgaccagatagagatccaacagtacaaaacaataggcttcatcgttgccgttgatgcatcgcgaactcgaagagtacgatcgcagacagcactctacatcggacgtaccgtagcccatgagcataaactctccgcaaaagtacgacagccccttgaccgagggcagtgctcgtaggattgctcgattgttgattcgcacccgtacaccgtgcctgtttagcatgtagtacttgcagtcttccgttaggcacagacacaggtggactcccttgaagctgggctgtacgcaatagtcgctgcacatggcgtccagatcggaaacgttgagcgtggcctctgtctcgtaggatacgctcggcagtttgtagtaggccatcagattggtgtcgcacgtaaagacgctacgtgccacgtgaaagttgtacatgccgtgaaaaagatcaaacactatgggctgatccttgatgtcgttgcgtatgccgaatcggtagtattcgggcagactgcgagtcagatcgttgacggtcacattgagactcatcgacgatataatgtaggcctctagcggtgtgcattgtttcaagattaaatgatgcggcgtcttgaacaattgtacaatggtcagtctgtcgtcgttggtttgttttttaggacaataataattactggcatcttggccgcactcttgatagtttacgtctagacgttcaaatgacgcacactgttgactacggcgtttattgcaaggctccaattttacagtgtctataaattcaattttactacaaccgcttcgaaacactttatcgctatagtagacaaagccctcgtcctgatccactagtagtttgcaaatcagtctggatgcgtcgtcgtcttcgaacgactcatagtcacacttgccaatctgttggagaatctgcttggatatcaggttgccccaacgattcaaacatgcacacttgtcgtgcatattgatgacaacctttttggcagtcctccacgttgcgatgagttgacgacgccactttttgtctataaacaatcgtatgcaacagtacatggattcggcatccatgctggtcagccacagagttagctgttccgagtttttagcataaccgttgaggaatcggccaatctctatgagtgtaaccattgtgtttatttctaacggataagaaggatggtaaattctaaaaaacaaagtcaacattattctaaagctatatttttaacaattaacaatacaagtgtaacaattctattaggtactacaacaaatactaaatactttgatactttgatactttgataggtgcctacgtttaacttgaaacacacacaaatcaatttaaagaattaccaccagtactagtactggctctatttaatctttccattagatttaaccgctcaaccttgttcataacatctgcgctatcgatccgactacgtttggccatgtacgcctcgtagtcaggatcgcgaatcgtactcgcatcgtactcgtaatcgtccgagtctacgattcccagattgctgggcactctgtacggcgccagtagaggatacggctgcggtccgaatgccgaagtgttcaaaacctccacccttggcggcagcggtcgtttgcgatcaatcaacggtcgatccggtttcagatggattcggctgcgattgatcgcatcgatgatggcatcagttttcgaaacctccttgtccgcgttcaaatcgtcatcttggtaaccctctgtgaacatggataaggtatcctgtacgctctctcggtgcacaggtcgtctgcctttgaatctttctgcagttccattgtttgctacattgtatgacacattattcacactgttaatactggctgcattgtttgcaccaccgatagcagattctttaataaatggcttgtaactttgttcgtttatcgtattggtgttatcgctctgccgagtattgttgtaatcgttgctttgcacgttcaatatgttcgaatcgttttcgaaatccaaagttagattagagtcgtcggcaaactctgcatagtcgtcgtaaatgtatccatcctcttcgtccacatcttcatcatcgtcgtcgtcgtaatcttctatctgaggcggtaccacaaatggtgtactcggacgtttacgggtggtttcgggagattgaggtttctgttgcttggacgtttgaggcatttgttgcatcggaggatgctttagtagagttgtagattttacggatattgtaggtttctgagttggagtgggaataggtttggtagtgggtggtttaggaataggtttgatggtaggtggtttagtaggtttaagagtagtaggttcattagtgggtttagtgataggtttactattagtagacttgagagtatttatagctgctaggttaggaatgggtctagttgttggagtagtaatgggctcaagtttggctactcttagtgtagggtcaagtatacttgatggtactgtatttgaatctatatttatacctgtatttatacctgtttttgtatcggtatctgtatatcgagactctctgactcctcgcatcatctcatctttcaagttttgtatagtctcagtatcaatgccgccagagagtccgacattgccattgatgccagcaatcccagcattgctcatattggctccagtaacagcaccggtaccagtaccggtactctccgatgcaggcgtcattttactaaaatcgataccggcatcgagcagtgccagtctcagcaagtctccgggatccattggttttctaggtttttcattttttggaagctttaaatttgtatcaaactctgtattggcatccttgttgttgtagttgttgtagttgttgttgctaccactttcaaaattcactagattgaacgatgcattgtttgcattggatggtgcatcgtttcctttatcgtcgtcactgtctccatctcctaatcctcctcctcctcctcctacatcctctgtgaatccatagtcttcatcgcgcagcattgtcaacaatagattccgattgacaatctttagcttgatcaaacccaacgatgtggtcggtgtgtccataatgtaacgcatgtacgattccctaagagtcttgttgattgcatcgtgcctaaccgtcaccattttatagtctagtggtataaagtctatcgagtcctcgtccatggccaatgggttcacttgaaacgtaaaatgtcgtttgatcaagagtgcatgtttgatcaccggcaataggatcgtgtagagcggctcgactcgtctgagcacatattgccggcgattggccgtgtacggtgtctgattgattaggtgcgtgtactttaacgattccaggtgtgcgatcggtacacgggtgcacagatggaggcacgaagcgatgacggtatcgattgtgcgcaaattgaccatacccatgtcgttgactgtaaacgttttaaactcttgaatcaatcgcacaagggtgatggtaaagtttttaatcacgctaccggtcagagttccgctcttttgttgcaacagtccaatcttgggataggtcagagtgactcggggattgagagacttgatcgtggtcaatatgctaatcttgtagttgtccgtaagtttgggacgctcctttgtaatttgctcaaagacgctctttatgttggaatctttgagcgtttcaatgttaatctttagatcgttcaagagctttaaatgggacgcctttacgttgctcattataaataatcttgatgtaaataatcttaaataacagtataatttagatcctctataaaattagatatcttttctaggagagagaaaggctccaactctctatatagttttgcccggaaatgatgctataaaaagggaaacaataaaaagcaagctgtaaataaatgttgtatctagagaccgagataagttaaattataaaattaaataaaaaccggataataaattatcaacggcactctaccattaactaatctgtattatgattattattattaacaataataaccacattacagttttacaacctctgattagaaattgtaaactctacagaatgaataatatcaataaacgtatagatgtagtagtagatactacacatttatgctataaattaagttacactgtagtcaatgtggtgtaaacttgtctagcaatgggctcggttgcaaattgatattaaatattattattatcagccaagctacagtagtagtgtagtatagttgtagaggtttggtggggaggtgattatttctcacgacttctcaataacaccactagtcgtcgtctgtcagcagtgttaaatggactgttggttcggtgtagttattattatacttttagtgtaggtcggtgtcatttttaaatagccatataaacgttaaatatcataaaagcaataacctattgagtctacgtttgcgtactaaatttaatttaaaaacagtgttttgtgcacatcagcgagatgaatgaaattgagagaatcgaaacttttacgagctccaactggaaggactcgatgattctgggtatgaaattggccaaaactggtttctatttctgtggagcaaatatattaaagtgtaccttttgcaagtgcatcctcttgtggaacagcaaagagtaccaagagtttgtaaacaaacctcaattgatacacattcgtttgtcaccaacttgcgagtatgcgtacgcaaatctgcccatgtacgctaatccccagtatcggtatttcaagtcgagactcgattcgtttatcggcaactggagcgtgttcaagaggcccactccgatagcgttggccgaggcgggattcttttatgctggcatggtcgattgtacaaagtgtttctattgcgacggcggactaaacgattggaacccgtgcgatgatccctgggaacagcatgccatacactttgaccgatgcgtgtttttactgtacaaaaagggcccactctacgtagagtcgataaagaagaggattctgggtgagttgtgttggttgttgttgttttaatatttagtattgtttttaacatttataaatgaacacctgtacttgtgcacatgtacgtgtagactaaatttacactcttatatttatactctcactgggcggtaattaaattgctgcaaaaagtagaataaacgatcccttgagtgtgcatccttcaagtgtagataaattaaattaattttgtctataaattgattttatctataaattgaatttgtctttaaattgatttcatctataaattgagtttgcctataacttgagtttgcaataaatttagagtgtcgtaaaccatttcatctgcatcatttatttaattcaggcatacatataaaaaaatctaaaagccacatttaacctaaactatactcgctctctagctctctgtactgttgcattccacctctgcataatacacactaacctttgtaaatatttaaacatcccattccatgtccattcaaggtggtggttgtggtgcagactcctcagagtgcaatgattgccaatttgacaaagctggcactggagagaatgtacgacgtggacaatcttgcagcacggatgccgaacctgtacttggttcatttgagtacactgattgcaatcctgctgatactattgctgccggcaatattgtagacttgaagaatgtccgatatggcagcataaacactagcgtctcttcagattgctcagaggacagtagcaacgtgtacagcaatcgggcaacgattagcgcaacgcccgtggtcatacaagactcggaggatgagcaatttatggatgcttctaaaagcgtacacaaaggctctttcatagagtaccgggccatttctaaaaatgaatacaacaagaatgagtacaaccagaatgagtacaacaagaatgaatacaacaagaatgaatacacttctaaaaatgactacaacagtactatgcgcagatgcaaactgcaccgagtcaagaggagtattgttgaaagctttgaatctacagatgcgactcccaatgtagacgttgacgctatggagagaggtagaggtgctagtgctattgagaaggctgacgctatggataattccaacaaggatggtgttgtagaggagcctagtgttgttgtggttaatggtagcactattgatagtagcactattgatggtaacacggttgatggtggccttattgataccagcaacgttatcgaggcaagtattatagatgtggactcggaggtatcaaaagtgagcaatgccaatacaggatctggcaatgctggagtggagtcaagtaatgtagatgtaaatgtggatgccgaatcaagtaatgcagaggtagatgcagaggtagatgaagatgtagacgtggatgcagaatataccaacaatgaagatgctactaatgtaggagagactactgaagataatgcagaatataatacagatgaggctacaaatgaaaatactgatgaaaacacaactgacgatacagatgaacatactgatgaaaatactgatgaaaatacaaatgaagatacagatgaaaacacagacgaaactacagagtacaacacagaggactacaactctacagacgtcaatatagatgccagcaggattgaaacaatcaacactagcggtaactgttttgtacattttctattgacagacactcgtttcctgaattacacattgtcaatgcacgcttccttaatacacattgtttatacatgcatgtacaaataaccattaaaattaacctcttaacaaaaagtaccatgtaaaacactctctccctctatcctccacagatgcatcgaccaataccaacatttcgataaactccaatttatcgctcaagcgtatgattcaacgattggaaaactctgacattggacgtcgtgcaagaccaccgacaccagagcgctgcaatgtacgcaatcggcctcggataatctacgtagacgagaccattggtgagttgtaaacgtccctttgtgcattaccaaaacttgcaagtaaacttgtaatttcaattgtagaacaatattgcagccactactgttgctgctgctaatgtttccactttagtgttggacccttcaaaatgttcaaactataaccgagccagaccgtcgttaatttataccaattgtaaatgctattacaataatagtagccgcaaggatagttgacctgattcagagggtgattatttacacggtatgattagtgtgatctgctcttagcaggtacttggttgataaatatgtgtgtgcgtgcatttgtttttagagcaatgtttaaatgtaaatgttaatgtaaatgtaaatgtcaaacacctacaatatacatctctatgtgtatagtaaaaagatgtttataaaatcagtgtgcctatatgtatatcaagttgaaatctaaatgtaaccttctacaaatccatctacaaatccttgtctttacacatttcatgcacagtttaatggttcagagaattatgtccagtgtcaaatgtgtagacgttagtttagtatagggccatgtataatattctagactcttgacaccaacaggtttgacaataaatccaatagtcatgccggctagttatagtcaaataacagtcgagttataataattctaatttattgttgttttaatcatttactgttagttttggcacgttatggctagttactgctagattgatcatttactgttagacctttagtttaccgttagtttaatttacgtaattagattactgtttggtgttgcatttgttgtgttttgtgtttgaatttgcgtgtgtttggtttggtttttgcatagagggtcttgttgtagatacttgtactaaatgtatgttgtatatacttgcaatgtttattgtgcactcttgtacaaaatgtatgttgtgtatacttgtaccaaatatttgcactcttgcaccaaatgcattcttgaatgtaaaacatgtatattcttctcatacaaaccaacctccatttcacagatgccgatgccgattctaccattgaagatgaacgttcaccgattgactcttctggtagtttggttaaacctaacaatgatgacactactgctactacttttactgaaaccactaacatcagtactgccgccaacattgatactcttcccatcaacactgatactaacagcaacgacacttttaacaatgcatcaggttatacatcatcttgtaatgcatcatctggtaatgcatcatcatcaacttgcaatacaaattacaatacaaattacaatacctcagactataatgcatcctacaacaacaactcatcctataacgtatccaacaatacaaatacatacaagcataaccatcaacctcaacctcagcctcagtctcaatctcagcctccatctcaggatcaacctcaaaatcaacctcagtctcaccctcagcatcaatcacaatcatcccagactataacgttgcacactgaaactggaacaatagacctttgtactgcatccgaagacgaagaggatgaggatgcaagtgactacattgacgacgaaccctactacagggacgattgcggtaaagtgatttacatcaacaatagtggcccattagagtgtagcgtgtacgtggacgaagactgcacctcggacacggaaccacggccagagtttaaaactatacagattgtcatcaagtctgaggatgtgtccagaaaggccaacaagtacaatactcaaaatagtaccaacaattttattgcaaacaatactactggaatcaataaccatagcaacaccaacaccaacaacactagcaagtatacaaacattgacaattttatgcattttcatcagtattacaaaccacaaaaccatagcagccagaaccaggcactggatcagatgcacaatcagtttaatcagattcagtcgtttaaccagaatgcaccctttaatcagtataaccaaagtctggcattcaacaaccaatgcaccaacagtcaatgtcagtgcaacatcaacacttcctattatgaatcttgcaacgagtcggaaacctactcggagccagaatactatgatcaggctccagactactctgaaatcaagactagcaacaccattggctgccagactagtgtcgagaccaatgtcggcatcacgcagacggacgaggaccattgtcgtctgatggatcggtccacacaaacgttgaccggtggtaataattacatgccatcaaactcttcactggactcggcctcatcttcatcgtcttcgtattgcttttacaatcgcatagattcactaaatggcgttattagcaattctataaacaagtctatcgaacgcaccgcactcctttccatttccaattcgtttgaacgcactcctccaccttgctataagcctcctccccggtactcatccccaaagtttcttacagttgacgcgtccaccaacacggagattcagaagatggatcaacatcagcaaacggacgcatcggtggtggtggtgtaaccaaggttggagtttgaagttgacgtcggtgtaattgttacaagttcaaaacaacgggatatctaaacacagtttaaatgaaataatgtttttaatgcacacaattgtagatcaaaaaactagaatgattcaattaaaactacttttaatttcatcttgatcattttcacactattgtaacttgtctcgacatacggatccttttcatactactattcagactacttttcatactactattcagactacttttcatagtacttttcatactacttttatgctcattctatggtggttgttaattttagattagtgtcttagaataggttcagtttgaatttagaaattaactatatttagaactacagttaaaactacagttggaagtacatgtttaaatggtttacatttagtaatacacacaagtagatttagaaatagagttggtattagatttagaaagagttggtattagatttagaaatagagttgatattagatttagaaagagttgttattagatttaaagagtataaaatagatttagaattagtcattaaacagtgtggatagatttaaactcaaaatgtacttttattgtaaacacaatccatctactgacactacacacatttataaatgtatataaatgcatacaacttcatacaaatacataactgcatataaattcatataaatacatataaatacatgtaaatataaaaaggtacactacaacacacacctcacatttacaagcctgctataaaagctaataacccctcagtcacttgggtactctttttttcaaagggtgtaaacaaggcgcgtacaaaacctctaacactagtggttctgcatactacacacaataacaaacactgtgggccacagtatcggtaaaatgtcgaccgcctccgctcatgttgacttgacgcaatccctgttgctgtaccgcaatattacaacgagattgaagagtttctcgagatggcccgtcggtctgcaacagtgtccagtctcgttggcagaggctggatttttttacagcaacatgtgcgacgaagtgcaatgttacttgtgcggtgtacgaatctcgaaatggctaccggaggacgatccgtggattcagcacgccaagtgttccaaaaattgtcgcttcctattgcgaataaagggtgtagactttgtgtacaacattacaaaaaactctacgtttatgcacaagactcagtcaaaggccaactttgcgcggttctttatcaagactgcggtcgttcaagacactgcggatcgtcagggtgagtgcctgctgtgctgttcgcatcgtgcagatattgtgatattaccgtgcaagcatctcgtttcgtgcggctggtgcgtgaccaaacagttggacaagtgccccatgtgtagagggccgactgcagaaattatgaaaatttacttttaatatttatatacagcttatcgaccgtaacgcgtatagcctattggtgttataaacggttcacatttatgtagttctgaagcattgcgttgcgagcattctcatactttgcgtgtgagcatactctttaaccttttgcatttgacgataatttaactcgacaccatgaaccgcgtaccgaaaaccaagtccatcacccaccaggagctcaccgattacatgtactatgagagtggagattttcagacaatcttgaaactcgactcgttcaacaagactttgtcgttttacgaacgcatacccggtgagcttgtagaagatctaaagccccttcattggtctccggcctgttttgacgagtacgttaaagttatcgatgccgtaataccgggagtgtacacttttgacgttgtcgtgtacaatggccagcagttgcacattgtagatttactatcggtcaacggtctggatattgaaatgtttacgtacaccgatcgcttggccaagattgcaagtctgtttgtgagcaagccgcccatgcagattacttttaaatcgctgccgacaagcagcaacaaactggaaatgtacaatggcccgtgcgattgtttgatcgtaaaagagctagtctcactaaagtacaacatggactacaagtatgtaacgcctcccaaagtgtacaagattgtcggctgcgcagacttgattcagcgacagtacaccaccgatgtggccagatggcgtagcgttgccaatgaactcgaactggaacccggctctgatcccaccaagatttcggccagttgcaagagtgtgctcatcaagacggccaaagccaatgaggtgctgcgcaacattctgacaaaggtcactgtcaagcaggtgcacctggttgccgatgccaagaacctcatctttggctattgcatattggacgattccgtactgaagcacgcgcccaccgtcaaagagtctaacggctacacttggatgatggccgatcacgatgaaaagtttgccaacattaaatacttcaagactcccagtgtggcatcgttcaatcacaagacatctggcaaaatggaaatgtacaagctgcagatgcaccggttgatttgcgatgacagcgagcacgttgtagtgtccaatctgccggtcaggatgcgcatagtggcagccagactgtccaagagcaacctgtccagtttgattacgatgttgattgaaaagctgcacttggtgcactttaacgacaacattgaagagtttacacactacattaaaatgttggaagatttattggacaagatggaccaccaaggtggcggcggttccattatgagcactacgttgccaaagaagcgttcccattctagcgaagagaaggacaaaaatagcacagcttccaagaaggcggacgttgaggaagctgaccatgctgaagaggaagaggcggagtctgagccggccgataagcgttctaaaaagtaaatgtgttggtggtagagttttagatgttgatgatgtatcaatagatgtgtgtattcaataaatgtaggtattcaatagatgtatgtagcaatagatgtatggattcaataaatgtaggcattcaatagatttactaataaatgcatctagctataagtttagataatagtaatgaatgaatgtagttgttagattagttttagttttttggtaaagtagatgtaagtagggagtaaattaggaggtaaagtaggaagcaaaacatgtagtagagtaggcgctaaagtatgtaggtaagtagttgagttaagtaacctagaataaaggaatcgtaaactattacaaccactgctacctattcaaactttgacttgctatttgaatcttactttgtagtatgctgtgtgtttgacaaaaaccactgataccttttgtcttgcaactttgcattgaattagggtcgaaatgttaaaggattgtgtgtgcgtgtgttttagttttttagaataatgatactttttattttttagaatactaacaattcttgttttttagaatactaataattcttgttttttagaatactaataattcttgttttttagaatactaataattcttgttttttagaatactaataattcttgttttttagactaacagtttgatttaattttttagactaccaagtcataaataaatatcaaaacatacagttgtggtacacgtgctgggaatcggttacgtttattaggttaatgtgcattgcgtgcgtgatcagagttttaattaaaacataatgtcagcgagagagaaatctattagaggtgttttctaaaatgtaaattataggatataaaattagcattagcatatagtctaagggaagagttgcactgagagatacttttgcaaagttgtaccggatgcattgttgtgtgcacatgtatttaccagtgtcctgtttgttcacattttactgactagtgtagtagtagcgttattattttagcattgttgcactgtattgttgtttcatagtaagagtagtacaagtctctctgacttgagctttgctttgcacgattgttttgactgttctttgaattggatttggtgttactatgtaggattaagtgtactggaataaaattaaaagtaatggaatacatttaaaagtactagaataaacttaaaagtattgtaataaaattaaagtactggaataaaattaaaacctgttggtgataagtttggtagattatgttttttgatagtgtaatattagttgtgacagttatatagttgtaacacttgcagttggcaaagctataaagacggcttgtgatgtaatgtttatttactaacctatacttgtagagtaagtaagtaagtaaataagtaagtaagcaaataagtaagtaagtaagcaactataagtacacaaactccaactcgtcattctatatgtttttgttgatagatgtagagagagaggtagagcacggtatatcaggttctaaacaagccaatcacttgtatattaacgtatagcctccaaccgagtacccttattgtaaacccatccaatcctagattacttgctacttgcttgaataaatgttgtgtgtagtataccaacacgtttcatttcaaagacccaaacaacctcacttgcaaatctacccaaagtgcccatataacaaatatccagaaactataatgtccaacaaaagtggccgttgatgggtttagataagcttacacctttccccgggcaccataacatttacgatttccgtataatgtaaattacccgaccgttacctactttatttataggcgtgtaatttattagcattttatgaccaattcaacaatttacaacaacattaattagcattgtaagtttgtattatgaataagaaaagttgatctgagcacgcgcacacactgtattgtacagtgctgtgtactgttgcaacaaagttgagattgaaaggtcaagtgtaaacacacgttccgtgcgttgaacaaatgacgagtcattggacctgtaatgagtctggtgatgtgggtagaatggtagatattaggtagcagccggtagccttttggagcaaaagctgaggaagtagatgtgtttaaaaaaagaacaagtattacttggttagtatatatatttatttaaataggtacaatttagatacatttatttaaaatacatttaacattaatatttatacaaatctcatataaaactaaatccccagcaaagactacctcaatcctcccatcccttcataatttcatttacacgcaaaaaggcagccatcgagtctatgttgtactcggccatcgtgatggttgcgtgcactcctcgctccttgacgttggcatcgtagatggcctttgagaggatctgatagatggtagtgttaatcttggacacaaacttgtacagattcaactgtgaaatgtgcacatcgttcaagtgatgggccgcctcaaagattacatcggtcggtttgtttttcaagtaatgaaagtatttgacttgcttctctccgaatatgtaatcgggctcgtcctccacaacggctcgcatcatctttgcaatgggcgtgttggcagtgtccaccttttcacgattcgtgctcatcatgcacagtactacgctgcgatctttgcgtgcacgctctgcaatgtacatgtacacctcgttgactagaatgtcttgtagcatctttgacgatatcggtacgcgctcaatcaggtagcgctcggccagtgtaaagatgacatcgttccaaatggtgggcccattcttgtttatacctctcgatatccattcacccttgcacttggccagatagacctttttggccattataaagatgaactgatacatcttggcggtcagttcgagttcctcattcagggtcttgcaaaactcgggcagtggattgttttccagattcgagtcaccattgtgtacaaacaccgaatcggtatcgatcagtactgccttaaagttttgcacatgagcaaaccgggccatgtctataatgtacttgcgtcccagtgtggtgagcgctgccgccaccagtctaccgctgagcgctccatagtcggaacccaagaggccatagtagctgcagttgacaatcttcaagttgcgatacaacgagttgattcgagacagttcacccttgagtttaacctcatagtcggtcagcaattgaacatcgttgcatcggttgatttcgtcaaaggttagcagtttaaacttgggcactagcattttcatatcactactcttgtccacatcggcagtgttgaatatagagccagtatcgcaaagttccatattctcaggtatggaggggtcgtcagtgttagagtcagttttagattcagtgttggattcagttttagattcagtgttggtttcagttttagatttatcctcagttttagtatcagagtctttgtcgtcctctttatcctcatctttatcctcatctttatcctcatcctcgtcctcatcttcatcctcatcctcctcctcctcgtcatcatcgtcgtcaaaatcaaacacaacctcttgatagtcgtcgcctctattctttaccgcatccaatcgtatctgcacctgggtcaacatggtttccatttcctttttcaaatccttggctcgagatcgtaaaacgttttgtttgtgaatcatgttgcccaatagagacggttttcgctcaacgctcaatattagcacacgatcgttggaattcaagtttttacaacactcgtccaatgaactaaattcatcgcaattattctccagcatattgatcaggttacgagtgtttgcatgatttacgacctcttccttggaacacttgtgcacggtaaatgtgaaatatctgcacggatggtttggattcagaatgggtctgagtcgctgcaatacgtgcaccggaacgattgcgatcgtttcatatgaaatgttgtgaccctgtttcaatttgggataataggcgaccacatcgttcactttacaattgttaaacacttctcgggcgatgcgcatattgaatcctccaccgtagctggcctcgttcactcccgccgacacttgattctgattgtacgtgtacatgacgctaccgttggtggtgatcattagcccaccaccgatgctcttgtgcagtgtcaaaatcttaccatcggtcaaactgctgtagacagacttgttgttgataaactctccaatcttgcactgcgtgtaccgtacaatggaaatcaaatggctcttgcacagcttgggtagaaactcgtcgtagctgagcgagtcccacagtcgacacagcagctcggtatcgacatcgttgtagtgcacaatggtggccaggtcaatgttaaacttttcaaagtggcactcgtcgttgggcaggcctcgttccaagaggtgccggtacacgtgtcgaatgttgatggcgttaaactccaccttaccctcggcctgtcccagacacagtttggccatagtgtccagcgacagcttgcccacctccggatagagttgacgaaagattttaatcaaatcaatgtgaatcatgtgattgccgtacactggcatgcctcggtacagggtaaagtttttaaactcgggcagacacaggtaggcggtgcgtttaataagaaaagtcatatcgtagcccttgctattgtagcccaacagaaaatagagcctcttgcgatccaacgtctgtaggatgagccgaatgagatccacctcatcgtgcacgaccaccagtttgcgttgcatgttgcgagtggcttcaaagtctcgctccatcaaactctttaggcgttccgtataggctcgtaccgattccgagttggcatccactgtatcggtttgttccaatcgtgcacgtttgaccacagtgccactaccagtagtggtgtaatcaaaatccaccggcactggtatattgacaaaactgtacattgtgttggtgccgtgatcctttatcgaggctgaaaacaaaatgtcattcttatagtctcccaggggtagtcggtaatcaaagctggacagagtctcgatatcaaaagccacaatgtcaatctttggcttgggcaagtcttcgtagcgagccagattggcgtcgacaaacacatcgtacaccgagcactcttccagattggcctgactcgtacggcacgccatttcaaagacaatcaacagctccagggaccaagtggccgtagtcttgatgtgattcttcagagcggtcgtgttcaagagtttgtgtaaattttgagaatcgccaaagctacaggtgggcacttgaaacgtcttgtactgaacactagtcgtttgaatcaacgtatcgagcagagtattgttgggaatctcaaagttgaacgaggagagctcgcgtatgggccgctccaggtcaacgtgtctgagattgagcaacggcgtcagatgcatctcgttctcggcaaacacaaagagcgaggtcttgacgttgttgatcattagctttgccgagtccccggactcgtctacaccgaacgcgtaaatctgattcttggtcgatgcccaatcgaggacgtagactcggtcggtccattttatagactcgtccgaaatcttgttgttgtaatagtgttcctcgtcagcgtacatcatcgtgactactaaaccacaaaacggcgtcactaagcttttatatacaaacactgataagaaattgcatttaaaaggcactacacttgcaacgctaccatcattaatatagcgaattctgcaaaggcaatacgctattgtgcttatctttgacgctagtttattggtttatgcacatttttcatcatgccgatcagaaagaatctaaagtcgatcattgcaaaaatattcaagaaacgcttcaatgccaagtctttggagtcgatcattttggatgcattgagcgacgtacaccatgccagggtgtcgatgagcgatgccaactcgcccttggattatgtggactcgttgagggaaaagatttgtgcctaccatattccgaagcatttaaaggccaaactctttcatcgaactctgccgcccgactactacctgtgtccgggcgtcgaaggagtctcgtacacgggctactgtaagcgatgcgatatccagtatcgctatccgaatccgttgtcgtcgttgttcaacttgtcgaatctctattgtgtagagtgttgcggtgacttgtttgataggattgatgatttatacgtgttttgaggtggaggtggtgcggttacttgttgagattaatggtgctttataatgtgtttttagattacagtattgactagttttagtgctagttctagttctaattctatgtagttttaaggtaatggttgtacttagtttgtacaaataaagatttttaatactcaaactgttgtgatttatatttttttagtttaactctacctcctgtaatcctcttaccccatcctcctacccatcatcctactctttcctttatagggatgcatccataatcaaatcaaaaccaaagtctcagtttcattagcggaaaacaacatttgacttgtaaaatacagactctgggaatccattggattgctttacatggactgaattacaatttcattatgcatctacattggcaggtatcgatcaaaagcttaatttactgggtgtctggtttaatttattgactagctactgctcggctgatgggctcatgtttatgggatcatgtttatgtaatgacattttgagaattgtggtaaaactagatgttggagcctaacggtacggactcggtggtgatttatagagttgaattagttacgagttgaattggtctaaaaaatacaaaaacttggtaggtgtatttaaatacatgtaaatctctacctgttatctaaactttaaactccaactctaacctctaaaatctctgtatgaaatctcagttcaagtctttgttaaaatccaaaagtatatacacatttgaatatccactgcattcaagttaaagattctgaatttaggttactctctcggatttttaagattctacatttgaatactctcaggaatgaaaacaactttgtattttaatcttggtttttattgttcagtttattaggtactagtagttgtgtgtgttttagtatttgattttactactattatattatgctactatattattattactactatactatttactactatagtactactactaaaactagaaaatttacagcatttcaaagtgttacatttagtaggaaggtgcaaggcagttaaacaactaggttgctcttaaatactagttacgtatctctaatactaatactaatactaaatcgtatacaaatcaaagagactttagtcacgagatatatattcatcaatcaatcatcacacaagctaccatgaaaacgtaggacactgcactgcatcaatcttgtaccgacgccacttgtacgatgcgatgcgggcacgagtggtcttggtgcattttctaaccttgaccatgttgagtgcgtacaagtctgaacactttgacttgtgctcctctaggacatcctttaccgattcgttcagttggatgctctcttcgaacgtgggcagactcagcatcattgcttcatcgtcggcaccactgttgggatccgcaacgacggtgttttcaaactctacactgtggaaagattcggcgcctcctttggatgcactctcaaagcgtgcagcactcgcagtcggcaacttgtccaataccgtagtctggatcggtctcagtctggtcagcactcggtagcagcacttttcctggctcggtatttgagggttgtacgtcatggtggtttgtgttacgatgcttgatttgtataaaactaaactccaactttatagtcaacgcaaactttaaattatacactttaaattcaaaattaaatcaaaaactaaatcaaactcataactgaaactagtacaacacaaatggaaatgaagtgaccatgacagaaatattgttacctaggcacagaggtaattcaaagtagtaaagtaggtacaatatgatggaatgataatataaaagtctatatttgaaagagcaacatgtgctctttgaatggtttgtaatctaaaaaactagagtccaaacgcctactgaaattgtagctgcaatacaacttgtgagcaactaaattctcagagcaacgggtcgagctgcacgatgattgcactctattcaaaacaggcgcccattatagtacagttcagatatagtacagatcaaatatagcacagaccaggagtagtacaacccaggagatgtacacttgtcaaggtttgtaggtcaactgaagactatcgtcaaatgttttggtttatatataccgacacaggatgtgacaccaaagggcgtgttgataaaccatttgttaattatagtcattacacaatgtatactagtgcctagcaccacatcctgtatgcaattttccttgatttgtaaaatctattctaaaaaaccacagtacaattacaagtaattaaaagagtcgttacaactaaacatgaacaaaagaggcatcttacagtactacaaacaaagtaatgcaaacaagagttgaaatcttataacctagcacacacatgggactctaatactaataccaacaccaacactcttactcttaattaatactagcactctaaccaacactaatactaataccaacactaatactaatcaatactaataatactaaacaaccactcactcggcatcctcctcgtcctcccctcgttcactgtaaatgctactgtccgcagtcatcaccgagcccatcaaacgagacacgtcaaacgcaatgtccgatttaacggtggatgcaatcttgcagttctccatcggtgccattataatcttttcggcatccttgttgatcttggtctctaccacatcgccatcgtacaagtggtcctttttcagtttcttgtgacgagtgttgagcaccgggaatgtcttgtttctacgcttctcggcactcttaccaatgttcataaacagagtacctctacccaagccactggtgcgcacatacaagtacgtcttgtcagcctcctctttgagcttgcccgaccaaatgttaatcttgttgattttgtgcggtataatctttatgtagctctgcggcaactgatcagtgggtaaacagtttagacgatccttccaagacttgaagtccaactgcacctgattcactgcacgcacatcgaaaatctcactctcaccgtctcgggtaaactttacaatgtcgtaaatcttaccgtccagagtgtgactctcggtggtcaaattcagcggcgtatgagtactgtagccgtacacggttttggtgaatctggccagagtgtcaaagtgcttcaaatctatgggcaggcaatcgtcgttgggattcaccacgtccgtgtaccggaagcaattgtactcgagatcgagtgccagagtgtgcaatttatcggccacgtccttgtagcactgttgctttagcaagttttcaatatagtccaagtactggatgcgctgtgcgaatgcgactcctttgcgtgacagtttgcggctagactcgcgcaaaacctccatcactgcccgctgtgcatagcgtttgttttcaatcttttccaagagaaacgacaacagtttggattgattcagttccatcaagaggctgaggtagagctttttgataatgttgtcattctgtatagtctcattgtacttggacttggcctccgagtacatggccagattgatgggtttcagtgtagacacggatccggacacactatagttaccggccaactcctcgtcatcgtcatcgtcttcgatgctagagtttagctttaaacgtttgttagagtcggttgtaaggtaacgagtcccaccggtgctgtatacactttcagcatctccattgctagcaacgatgctggcactggtactggtactagtactagcactagcaccaacactaatgtgatcatttacaacagaattggaatcgtcattgtcattagagtactctttggtggaatctttagaggcatctttggactctttgaactctttaggtaagttaaactctttgggtacgttggaaatatcctcatccgaatccccatcacccctatcctccctatcctcatccatacacccatctcgagactcggaatcttcaatgttaccgttactggcacttatgcaactattggcatttccaactccattgtccaacagtttctttacatgattgcacactctagaataggcatcgtaatcgttgatgcaactcgcatccgaattgtagccgtcttcgtcgtcctcatcgtcgtcctcatcgtcactgtcttgcttgtgattttgtatatacgcaggctgagcttgtataatctgatcagactcaacctgaccctgaatctcagcctgagcctgttgttgctgttgttgttgttgctcagccttactcttgtccttgtcagtgtacgatttgcgcagttgctcggcaaacttttcgtacaccaaagagatgaaatgcttcatgtacttgtccagattcataatcatgtcggtatcgtactcggaattggctccatagtagtgagtgcgtttggatgcaatcaccaccttgggatgagtaccgtacgtggtctgatagatgagaaagtaaataatattccgagccataatctgatactgattgttgcgctgcgtaatcttggactctttttctacctcgggagtgactcgtttacgtcgcagtttgagtgtaatgatgcgagccgttctagtcagtttttgaatcatactggcaaaaatcttactctcaataaactgttcaaattcctgaaacaatatttataggttaaatcgttacatcaaaagtgagattaaaacagtgttgaaaaatggacattttcctatgcatcgaaactagcaggattccaagtgaccctgaaatttacaacaaacccatatgcatggaatcgtcgattctctatgaaaagccagtaatcgatgtccaatacaaaaatgtacaatacttgataccaaacacgatcacgaagcagtttagctactttaaatatgcaatgacgatcaacgcctacaagcatcacatggtcgcgtacatgtttcgtatcaagtacgaggacgcgtgcaaactcataataaaacttacttgggagaatttgtttatgttgaacgaggccatctcgtcacccagagatatcgcactcttggtcgacgatttgaaaaaacccccaaactggacgtttatgacgtggctaatgtcgagtcggccaaactttgaaattgcctacataaattcaaaagacttgacagacgtgcgactgtatcaaccttatgttgtggaatgccacacaaggcgtatagcgtattataattatggcgacattacattgctcagataacggttgtttacagtagggtttgttagttttaatcgcaatgggtgataaaaaacaatggcttaccgtggagcctcccatgtttctatacatgatggccttcatgacgaccacggtcatcgagcaggcgttttacgtgtaccaagcgtgcaccgtcaaccatggctactcgccagaggtgtgccacaacattagccagtacgatgacatcaacaaccgagtccagcagactgtgtctacatttcatcagtggaacggtgtagccagtcatgtggtgccctttatattggcctttttcctaggatcctatagtgataggcgcggtagaaagattgtactcgtatgtggactcgtaggtaaactctttttctcggcaatgctaaccgtaaacagtctcaagagctggcccgtagagtatataatctacacggcatcctttccgagtgcactcaccggagccgatttggccatattcgcagcgtgctttgcctacattgccgatgtgtcgactgtggagaatcgcacgctacgagtgggcatcttggatgccgtctacctgagcacgatgccaaccggtgtggcgatcggtagtgtgctgtggaagcgattccgatcctatcccatcatgtttgcgatcaatacgagtctaatgattgcggccacattgtacacgatcctattcctaaaatggcaaacgcgaccagagcaaaaatccctcaaagaggctggcctcaagaatgcactcggagactttttcgatttggaaaacatcaacactaccctgaatattctagtgaaaaagaggcccaacaatcggcgactctttttgtggttcattttgctgtcgatggccttttatacgtttcatcgagacgagcgctctgtaatgtacatgtacgcaatcaaagagtttaaatgggacacgactgcctatagccactttagaacctacctgagcgcaatgtacgttacggcgatgctctttgggataccaatcatgagccgaatctttaaatggaccgacacactgattgtaatgctgggcgccgtggctcacatctgtggacacttggtgtacgctcacgcaaagattgccaacctatggtacctgggagcgacgctggccgcactgggaccttgtgtggctccactcttgcgatcgatggcctcaaaggtgctgcctgcttcggagcgaggtgtagcctatgcctttctgtcggtgatggagaatgccgttggaatgtttgctgcggtggcgtactctcagctctacaaaaacactctggacacgcagttttcaaatgccacattctacctgaccgttggcactctggtggcagtgtttgcgctcatgttgaccatgagccgaatgctaaagggtaaacagttgaaggatgccgacagtgatgactatggaaactctaatgatgaaatggggcatgtattatacaatggaggtggttcggtacaattactgttcaacggaaaggttgccgagtatcgagatttgccaatcacaaatgatttgtgtaacccagagtttaggtatttgaaaaatgtaaaagagtttgcgtattagtgtgtagtttgtatattaatgtggagttttagtttgtagtttgtatgtagtaggatagtgtaagtggtaggataggatagtgtagtaaatacatttatatgtacattaaattctatcaaataaaaaatgttgtattttttagtttcatcatttgactctagttttacattcttataaaaacttcaagttgtactaacattacaaaatacctacaactctttattttttagacaccaacatacacggcttggaatgagctcgtgtacgggatccctaagcacacaataaatttgaaaaatgaagtttgtcacatttacgaccatcgatgaggatggatcgtttgacaacaagaaggccaacgagctcgttagagttttaaacaataatgccaattgtgtcggtggattcattgattactcatcgatgtatccattgatttttgtatttgcatcgtgcacagaaaccatgttttgctacaatctaaacaatgagcgcgatccctttgtcgatcaattggaggctctggtcaaagagtccaagattgtggtcgacgcacagcaagtgtgcaatcttttactagagggttttgtcaatttttcgtttgacgctcgtctaagagtgtgtgacattgtgcgtgtgctagagctgttgaattgtatgattacacgaaaaatgaaaaacaacatattatacggtgtaagcggcgaagctcgtaaatgttattagcgttgtatttgggtgaattatgataggtgcacggttgaccaaagtatacacatacacacaccatgaacaacgcaatcaacaatatccgagctcgcatcacaccggaatgtggccgactggccagtacggtttttgcactgggtatcatacaatcggtggtgctggttgccatctcgatcctcttcctggcagtttacttgtactacaacgctgacgttaaggcttcgagtacgtcaagcacagccgatgaattggaaaagaaaaagaagaagattaagaccatgatgattgtatcgatcgtgctggaagtggtcacggtactggcctcattgtggacggtgctgactgctggcaagattaaggactgtgtttcgttggtttcatccacataaattgaagctgcctacatctaccgagtgctctctatgtgatgcgtaagagtgtatggtatacatcaagtgttgtgttgaaatgcaagttgtacatcaagtgtttaatatttaatacatcaagaggtaatgtgtagtacctatgatcagttgaggtgtttagattaagttgaggtcgtgttagggtagtttgttttagtttggtatagtataatttagtatagtttagtatagtttaggatagtatcgtttaggatagtctagtttggtaatttggattagcagtacatgttagattaagtcaagttctttagtaggataggttgctggaaataatggaatcgttaaagtactagatttgtgtaataaagatagatgaacgataaatgacaatattaatgaaattgaaataaactgaactaaactggaaactaaataaatggattctctctacatctttggtttaattaattcttattttttaaactatagattaaactagatttaaaacaaaataacaaaatataaaatcaaacccaaaggtaacactcaaccacaacccccccccccccaaccacaatgctgcccgtctttgtaggaacactctttgtggtaggtttgttgtattttttgacattgcgtctagacaactctaaatactatgcctatgtcaacaagtacaatctacaagccaaaaatgaaaagctagccaaattgataaactctgagggactcgagaatctaccgtcactgctcatcgaccacaactcttcctatgttcggcaacacgaagacttgtccaaggtgtcgcagtgtgccgcagagcctctgttcgtagcaccgctcgatccaaaggacaagactacgctgttgcagtacaatagctattgcacatcgagatgcggttccctgggccgaatggtggtcgtgagtcccagtcaagagttttaccacatcaacaagcgtctgccacccggcaagtattgcatggtcgacaaccaggtaaagtgcaatcctcgcaccggctacgtggtggccgacggtctgggctcttgggtgtgccgatcaaagtaccccaacctgtttggcggtacggatgcgtccaaagtgattgcatgcaacaacgaactgcatccgtccactggcagcatactgtgggacaatttgctaaatgcaccagtaaatgcggccaccgtgacactggacgacgagaacgaattggtgcccggcaccggaacgtataggttcacgtgcaagtttaacaacaccaccaacaaccgagtgctgccgcatcccgcaaaccgattccatcccatcaacgatccgtgcactcgagaggtgcccaatgcgcacagcgatgctcgggtcgtgtttgatcacgacgatcgaggcgttgccgtggactggcattgcgattgcggtgatcccaaagtgactaggctctacaattcggacgccaccgacaacaagtctacgtgtacgccttgcgtgaatcgaaccacacagacggatcgcaaactggacatttccgtgcatttcaagtgtttcaatctatcgtccatggtgacggatctcttcaaaacggtaccgtgcaagtggtcagactttctgagcaacggaaccagttgcaactatctagaattggagctgtacgagactcgcaactttatgacaccctttgacatcaagtataccaaggttgatggtgtattattaaactaaccgagttttacctttgtccaaattttacacatgagctattgatagtaacgttgaggcggcatgttattagaagtcatgtcaagatgaatcaaataaaactggccaatgctaacctgtacaaaaaggccgcgctcatgtcatggttggagcgcgaccgaatagcgtgcgactatgttaaacgctacggtaccgagattgatgtggacgcgctcaagggactctttgattttgcctctcagctcaagctggaaagcatactggtgtcggtgggcaagtccgtagtacgatccggttccattggcgtgatcaactttttgaccaagattggcatcggcatcgatgccgtcttggatcccaccaagattgatcctcatttggacgatgacgatatgatttctctaattgagcatcgcatcgaaaagttgtccactcgtgaaaccaaaaaacattccatctactataatgtgactatgaaaatgtttggtcagatgctcaatctgaatctggaaaagattaatcagtctatattcaagaatgttgacgaatcggtactggacaagctcagtgaggtcacattcgatacgaccaatgaaaatattaatctggatcaactcaaacccaaaactgatcaagaactgagactgatggaggaacctacagtggttgaactcgacaatgacaacactggttcccatccttcgtatgacgtttccacaaacgaggtagagtaccacgagtctgagtttgaaccgttgcccgatagatttggacggtatcgtaggagtgtagtagaggacagtgtagaagagggtttcaatggtggtttggaggatgattttattaggactgagaatggtgatcttaggacagagaatgatgatcttaggacagaggacagtttaggtagtgcaacagagtcgagtgtaaaggatggtagcttggagggattggatgcgtcaaaatcgatagatttgttaaactcattagattcatcaaaaccaacagattcatcaattgcactagattcagcaaagtcaatgaattcaccagagaatcaattagagccaccgactgcactagaattggaatcatcaccaaaatcattacccgttgacgatctacaagaatcggtaaaagaggtggcatctccagttgatgcatctctacagtccaatgctatgcaatctaatgctatggacgtagactttgaggatgatacaagtgttgcacctctatccaacgagtctatgaatcctaaacatgtagagcatgcatcaatctctccagagccagatacggacactgataccgatggctcaaacgatttggccaaattggacattttaaacaccatcgaagagtacaagaccaagcagacttcaagaaagcgcaaagcgaccactgctcccagtaagaacgagtggttgttcaaaacgttgaacgaagacgattcccgaccagattcaacgtttaatctctttgatgagtccaacggtgaactgagcggtctggcacaagagccaccgccagacaagctagactctgcaatcatgggctcgacaaaggccaccgcaatcatggatgccgactcgcagtcaatggacgagccaccggccactatgaaccggctaccaaagagcatcctgaaacgtacccttgaaatgggcagtgagcatgttaccaaaaagagcaaaccaacgcgcagtgtacagtttgccaagaccaatacagagtttgatgtactgaacaacattaagccctttatcaaagccaagcagggaaagaatcaacagcagcaattgaatctgtctgcgttggggttgtctacagttttgtagggaggtgatgatagacttggttagatttgtagagttgtatagaattgtttagagctgtttagaactgtttagaatagtttagaatagtttataattacataggattgtataggagtttataggtttctataggatagtattagtaagtaaaagaatagtattagtaaataaaagagttcacaagtattgtaaaaaatatacatatattgtaccatgatgcatttttttaaactctaaattacattaaatatatattataacataatattattttttaataaaaaattaaaactagtgtatacaaatctctctatacatgcatacaaacctccaccaatccttctacctacacctctccaaatccttctacatgaatcctctacacaaactctctaaactccttctcaaacaccacatttccagaatcgtaaaagtgcgatgtagtctccatcctccggtgccgattgaatctggccaccagacccaacggtagattggcaatcattcgggtcgtattgaacactcgtatcgactgtatgccaaagagttcatccggtgaggcacccctctccaacagtgcggatcgtagcattttattcaatgtggatcgactgacggtcactattcggtccgagtcctcgttggtgtgactcgttaaaaagtctaggaatttcaatagaatgtcacgtatgtacaagactcgtatgaagcgagaacgcttcttgattttaatgtttaccttgcgaccttcgacaatgtccatcagtgatttcctagtcaactgttgcagttcgttcatacgcaaatttgtacagatgcacagtatgatggacggggccagttcggggtacagccacggttcaccggtcacgtccaacaccagacgctcgatggcattgtgcgtgacaatgtccatctttttgtagagagccgtacgctttggtctcacccatcccaccttgggaatgatcatggagagtatcttgcgatacttgtcccgatccaaggacttgacgattctggctatctgtacgattgtagtgtttcgatacttgtccttttgagagactagcaactcggccaactgttcggctgtgagttgagccagatcaagctcagtgcccggatgcagagactcgtttgcacgttgtaaaaagttgaacgcgtaacgtatggctcgaatgtgactgtcgctgaatttgacaaattgcaagcgatcctgattcgattcatattgtgtagttttatattgtgtaggtttgtaatgtgtaggcgtagttgtatttttataatgtgtaggttcagttatagttttataggatgtaggcacagttgtaggtttataggatggaggtgcagagtcgacctctaccttgaactctttctttgaagtcatgttaagagtctaaaaaaagatgtactagtattaaataaaaatgagtacatgtaaaataaaaagtacatgtaaaataaaatgagtatatggaatgtataaatgtaaactggataaaggtataaatttataaatgtataaaggtataaatgtactctaatcacaacaataataatacaccaccaccatgatttgtaaaatgtaaaagaatgtaaaagcatgcaaaaactatctactactactaccactaccactaccactaccactactactaataatccaaatttatcatcatgcacacaaccaaggttcacaacaaatgatgtaatacacaaccttagtaatacacaaccttacctgccatgttcttattttttaaccacaatcccaaattgcacaaaacccaagtagtctaggaataatactctaggaataacatgtaaaccccacacctaaataatactctaggaataacattacaattattcaaacaagtaatgtaaccattcaaacacaatggaagactgtaacgtaaatcttaaactaacattatattcttaaaaggaatgtataaaatatcataaattctcaagtcttaaagttccttataaaataaatccttgtaaggaaatccttactagctgcaccggttgccttaaatctaaatttgttcgtcagttgcatataatcacattttgattcagtagcactttgagtatactttttgtagtacaattgtacaacttggagtatacgcaatgcatgcatgcacgtatgcatatactagaatctcatctagtcatactactcggtatcaatctcttcgtctttaccgactgaatcaccctccccattactgccgcctctgccagcaccatttctcttcattccatcgatcctagcaactgcacttggtctgccacttccacgtcctctgcctgcactgagtctctcggaattgtcgtcgatcgaaccccgtctgcggtacatgggctccagtaccatgggtttgtccggatcgatagcttcgtcagtgtcctcctcgttggcctctatcagtcgcatgcccctggtgacttttctgccgtcttcgcgttcgtacgaatcagacttgtacacccttgatatggtcataaacgagcatacatcgtttgtatctccgatcacgtctagacggtgctcgtccaccgaactgatttcgtgtatgggcttgatgactagcacgtcttcgcaattgggacggatcgaaatgattcgaacgttgatgatgcgcgaaaacgcaaaggtcgacgaatcgctgtccactacgtccacgagcaccgtcaacggatcaaactgatcggacgagtttacgctcaagtctttgcaatctataaaggagcacttgttgacctgaaagaccaccttggcgggaatcttttgattgtacaccaaaatgttgttaatgtgcaagttgtcacactcttgcagatagattgcacactcggcatcgtgcattgtacagttttgaatcttgctaaactcgcagccttgcatgaagatgcactctcgggacgacaccacaaaggtgacgtttgatatggtcaagtacttgcagtcgaacacatcaaagccgttgcccacaaagaagagattctcaaacattaccagtttgcagtctcgcaccgtgaccagaccgtcctccataatgtggctgttttcataagtgcaattgttcgagttttcataggttacattgcacgcgtctatggagcgcagcaggaccttttgtgattccaccaccttgagattctttatggtagagtgttccaagcgggcattctgaacgttgctcagtgcgaaccagtctacggtaatgttgtttagctgcacattggacatgaaactgatggtcaactcgtccaaggctacattttcaaagcgacacgtgtcacaattcaccatggtgactcgatccatagtcaccgactctatgttcatgtttttacagtctcggaacgtgagcattccgggaccggtcaccttgctggcattggccgacaaacccttgatggtaaagggccgaccctcttcgtcgctattgatggccacagcttttgacattagaaaagagccggcttcgactaggcccacgtctccagtcttgagcaagtgtgtgataaaggcctcgatggcttcggtgtcgtccgtcacaccatcgcccacagccttaaagtctcgctttaaccacttttcgtgattgatctgaatagactttattgccgtgttgatggtggatatgcgcgtattgaaacccatctcggtgtctagttttgctgccaaatccctaatattgttcaggttgcctagaaagtctagccggttgagcttctcctgaacctcgtctcgagagcgtgcaacctctgccagtttaccctcgtactcgtcgcgttggtggtccagcgcatcggacagggacttgatgcgcttcgccaccgcaccgtcgtccattatgctgctgtcggtcaactgtttcttgtgctcttcgaatagcgcgcgtatggatcgagtctgtacgttgacctgttccagattggtgtcaatgtactcgtgcagtcggatcgtcaactgatcacccaaaatgctcggatccgtagactctttgagtttattaaacgacttttgcagattgttgttctgctcgagtacattggccaaaacctgacaagcgtccacaagctttacgtgcaccgtttgcaactcttgtttcagcttgggcagttcggtcttgatcttttcattgacatctaccgtgaccgtggattggagttcgtccagtttgacttgtagtttggacatgcgattgttaatgtcaatgtcggcgtgttgcaatatggaaacgtctcgatgcatctgcttgaggtgttcatcgttgtcatcgttggtggtcgactctctgtgttcttggaccagcttttgcagctcggcaaggatgctatcgcgctttgccaactctcggtgcacttcctcggcgttggcgtacgatgccaactctgacgattccacatagttggctagcctcgagccaaaatagttttccatgtcctcgtctttgtcggtcgcactgtgcatccttgcctgagtctgcacctcttgttcaatcttttgcaattgtgcacccaggtctaggcacttgtcatcggaactcgagtaccatttgctgtggtagtagagtaccatgagcccgttgactagtatcgccacgaccacggcgacaaatataaatgtgaaattcatgagctgtttcgatattacacacgcctcgctattgcatcgaaatgatttacctcaagcatatatacgcagttacaactaaacaccaataccgtattaagagtgtgtaccggtcaaacattacagactgtaattttttaaaaatgtttgccaatcgtcagtatagcgttgattctcacgagtcgatagactctttggtcaagtcaaagattgtctcctgcctgaccagggacatgctaaacgagatgttgctcgagcccgatcggttcggtgaagagtcctatttcaagtttctactggccatgtactgtaatctgtgcgaactcacaaccattgcatactatcccatagagtggcacgatcacgagcccatcatgcactacactagaaaggatcgcaccgtggtgcacctcttttccaagcccgtaatcattgatctcttcaaaggcatcatcggttcgaatacgtgcaagtctaccgagttggccaacaccaatgtgcgcattaaacagattcatgtgattccaaacaatggaatcgccttggccgatgggatgccaactctgccgtcgcacattgccgataagctaatcttactcacagtgattgccgatcacggcgcctggcactattacaacctgaagcgttcgcgcaacgccaaagagtacagactcactgcgcatcagctcaatcggcacattagtctggcctcgttgatcacgtccagtcccgattcccaagtgcagaaacagacgaccgagtgcatgcatccgtgtttgataatcaagacttcaaacgtggactctgatgcaccggtcgtaaactgcaacactggcaattcggaagacgatggagactatgaagacgatgacgatgaagatgagtgcaacgaaccgtttagcaccactcgcagaggcggtggttacattaaagataaaggctcctataaagatgccaacgactcgtcggcagttttgaattcaatcgttaccaaggattactatgataattagactgttgcgtgtatagagttgtaaactgaaccattattagcatgcaagcgcaaagtcataatcagcttgtaaacagaccataatcgtaaaccatccaccgtgaaagtattggcactttgtacacgtgcgagttgcgagcactaaaagtgtaggagtttgtgcgttgccattaatgtaagggtaggcgtttggcttgaagagaacttttatagtgtatggtactagtgtccatcaggtgagatttaaacagagcaggtattgggatatcaattgaaagaggttggtatagttttataaacatttattatgtaaataaaattatcatgtaaagttgtttgtaaaattatggtattcaaaaaaatcacaatcgttgtctgtttgctttgtaaaataaagtcattaaacaagtaagtattgttagtgttgttaaagtaagtaggttagattgtaagagctacaattgttgtagaaagagttaaaattaagtaagtgcctacacgaaaagttttagcaatacacttgcaggatagttgccatcattgaatagaattgttgaaatacagtacagtctaaagatggagatatgtttaggtaggtttgtattttttaaccattaaaaatattatgctaattgagattctaaaaaactaaaacatactaatacaatctatgttaatacaatctatgtatacaatactaatataaaatcattacaaaatattatactcctacaaaatattatactcctacaaaatattatactcctacaaaatattacattcctacaaaatactactacaaatttgttactagttttgctattagttaattagttaggtactagagcttttggcaccacatttggcatcacaacaatgagttggtaagagttggtaaaaactaattacaaccatcggtatacatttataacaacatttctgtataaaatataaaagagttcatctataaagtttgttaagagttacccagtttccatcaccaaattttaaacatctacaatctctactttctccatgaagatccaccgctgctgggcttgtggtgccaaaagttcatcttgtgatgatacttgttctcggtgtagtcgcgcgtataagtctgcgtctctacactcctggttgcgggcttttgaacagtgtgctgaacttgttgcacagacggtgtggcactgtagccatttgtcgcactgctatagctcttgaacgcagtaccactgctaccgttgctcgatccgttgccgccattgctattggtcagagtgatgcccgacttgtagaacgcacccgatccggaaccagagcttccaccgtagccagaagagccactgctactgccagtgttgtaagagttgtagctacccttgtagccagaattgccgtacttgttgtctttgtacatggttgtagtaggtaggtattctcaaatgtaataaacagcaagtgacactacacttcacaacaaggatgcaatatccactggctgaatcaccgatactgaattatatataaatatccactatggaattagtttgaatttcccgagtaggtagtagtgtttttatataaatgcaaatacacactctcggtatgggagtcggaatattttaaaataactttaaaatatctggtataaatgctaaaggcaggtagtttttgtatacacgaccaaattttggcagatgtttacaaaatgaaggttcacaaccgaatgaccaaacctcgaacagaaccctccttaaatacccatcctatgaaaaaagtttcaaccaacaagcacgcacactatacaataaacgtatttttgataacacatttacgttattggcgataagtatgtgacattttatgtagaattgtactctgtttgaacaatgagttcgataatgaaaatgaactcgatccttcaattgttcgatgttcggtcgcctgtcgcgtttcatccttccaaactgaatccgattgtggactcgttgaatccagactatgaaaatgagcaggatcgcttgtacaaagcttaccagactcgtgttgtcgatgttgctcaattggacgatttcaaccgagtctacttggactcgttgaaaaagagtgcagtaaccaccaaatctatatgcatcgatggcatgagcgcagtaggcaaatcctccattgccacccggctcgacggcaagatgctcaagccgggcagtggctctagattgatttcgcgcaattcgcatcccagctcgtgtatggcgtacgtgttcaattttatcaaatcaatgatcgaggcggacaagggtggctcggtgactctgtttgatcgtttgcctttcaacacgctcatgtggaacaagatttggctcatgctgggacgagccgaacgggagggtacgattgatgagaaacacatgtttaaatacaccgactacctggactcggacgttatcgaatccatggccatgttgtcgttcaacattatattggtggactcggatttcaaacgagccgcacaacgattgcgagcccgtgaagaaggctgcgatgtggaacgatcccagtggtggcactatatgccgattcaatactttgcatatgtggctctgcacgccagatggccgcatctcttttacctgatcgatttagagtccttcaagggtgaccagagtgcgatgcaagactatgtggtctcgctcataaaacgcatcgactgttttgcatccgagggccatgattcaatttacaagtttgaaccgatcgacatgtgcacgtacaccgatgccgagaccggtcaacgagtgccgtacgtgttgtgcggtgatgttaaacaggaaagattacgtccgctcatggacgtgagctttaccgatggcgtgaaacgattcacgctacgacaagatgactcggcacactttgtacgattccatctggttgagccgaacggagtcttgttcgaagtggtggacaagaaacgatgcaagcgctacaaactcaaacgcatcaacaatgggaaactctttgcatcggccaaggtgtgcgatcccataggtttgtggaatcaattggtggagttgagcgatggagtgttgatcaagaacagagtgctccgattcaaaaacaatcgtagtcgattcgagtttgttaaaatgttacagaaacgagtgtaggtgaacgtttgttggtaggtgatgtaaggtaatgtactgtactgtaatgtaatgcaatgtaatataatgtactgcaatgtagtgtactagcatgtaaagattctctacaactctttgtacttgtataaacaaattataaataaatgataaataaatattaaacaaataatgaaccaataaaaatctatccataaattctctcttgttttttagaatccaactagtctacttttttgcatccaagcatctcatcctaaacaaccggatcccttggactctaacctctggctctgagaattaatcaaatagatttacagactaattagccataggtagaggacttttgcatttccagaatccattagactcgttaggtttagagagagatttcattacatttgaccatttgcttgattagttcaattagtaaatttaccattagtaggcaataaacaagtaattgaagcaattgccagtattggtaatttgaatgcattagcatgtaaacatgtagtacactttgtaatccatgattcatgttttttagtatggtacaatgttaaactctcattgtattagaaacgccgtgtctagacttggtgtcaatcaaaaggcctacctacataaacacttcctgtctatacatattgtagctagatccgagggctttctaatgtcaatatctaacggtgaattctccatttcaatttaatacctacttctagttgaatgtaaacatcttttagaaactcggctttttccaataaaaaacaccttggctttatacaggctgtaagttgtaagctgttttttagattgaataaattacactgaattgtatgtttacacttgttctttatgattttacgtagtcttgtaattttatacctttacaagtgcacctttataagaaggcttatagttttacgagtgcactgtacacttggttaattggctttgtttgcatttattatacgctcagcttttacacttggactcgggctcttgcacttgagttgtgattttgtttacatgctagagatttagtttgttgttgtagtagttgtagtagtagtggtagtgtgtattgaatgtaattcagtttacactttgtacaaggttactgggttagaagattgagggtagaaagagtggccgtgttggtaggtttgtattggttgtttgtgatggggatttgcttgtgatggagagttgtgtttataatggaaggtatcagtgtttgagtgtcatgtaaaatgtttggaggctggtagtgtttaagatgggctgtagaggcttggttagatttggattcaacagaaacgagtacacttcttttaaactagaatagactttattcagcataaactacaacctattcaaaaaatatcaaacatcaagtaacattaacatcaagtaatatttatatcctttacagcagacctatgtataaagcacatcagtctttgactctacaatattcaaaatgtacatttattaaaaaatatcataaacacatttattcttgttataaatacatttagtattacttactatgaagatattcaacattacatacatttagtagtactatggatacatttagtgtaactcttagtttacagccatttacttgaacattaaacttgaacatcaagtttaaattatctcacaactttatagtattacaactagtattagatgcaacattaaactatattgtacactatattaaacatttatattgtacactatattaatacaccatattaaacatttatattgtacatattgtacacgtgcactctacacctactatattgtacaattatattacaccaattttagtatgtttcaatttactatgcttcaatttacaatgcttcaatttactacacttcaatatattaccctacaatacactacaatacactgcaatacactgcaatatacaacactacaaactgctacaaactaccaccaccacacatactaaactatcccctatattgcaaaatacaaccatcaaatctagtgtttaacaaccactttgaaactaaactgaatccactaatatccactaatatctactaatgtctatatagtccaacatttaacgagttcaaaatccgagcaccaccacctaatgtttaacacccatctgctccagctttatcttgacaaagtttatgaaatcgtcaacctccggtgtagacttgaacttgatcaaattcttgacaacattggccgtacgattcacatgtctactgtactctttcataatattgttccacacaaacttgaagctcttgtccaaccgagtgtgtacggccatctcaatgttgcccttcatctgattcagcttgttgtacacatagaagcccttgcccattatacagcccagagttttgccacatctacccttgcgatacactacaaggtagcgatcttcgctcttgaatcgtccgggtacagtctgtttggtgggcctgtatcggatgcgtctattcttcctcagtctggtaaacggtccctgtggctcttcgtccatctctacattcagtttggaatcggaatctgcttctgctgtaggctcagtgttggcatctactttgaaatctactctactagcgctactgctgctattgctattgctattgctactactgctactactaccaacaaccttagcctctacctctacaacattgtcaacacaagcctccttgagaggctctaacggaccctctagagattcctccattctgacaccctccaccaaagagccctccatttcgtccaagtgttcaattatagtgtttagattgacattgccactgcacggttgcataaagtcatcgtcgtcaatcgtaaacgccggcgatagactctttggcgagtccataaacgtagactcggattgaacctctgcgttaatgtactcgaacaagtcttccatgtcttgggccagattcaggcacggctctatgcaatcgtccacgttaatcttgtccaaatcgacatccttgcactcttcggtggcatcgaaaccaaacacttcgagcgcgtccaagtcttcggtttgtgtgcactgatcgacacggacaacggcgtccgtctgagttgtgcactcggacttgttagcggcacccatctcggtcgagccttgattcgcgactcccgagccgtctttgatgtatgccttctccatggcgagtacggcctccatcaatttctttatagtgtaatccctctgtttgattttacgcttgagtagtcgcgtcaacccctggtagctaatgaattcattgtgaccgatcgacatgcgatgattcggaccgagtccctttatacgcagagagccaaacgcgtcggccaactctttgctattgaaccaatactggttgcggagtactagaggcatgatgtgtctacaaataaaactagacctcaaatgatgctctcaggtgctactagtggcttttattgcctggtattatctggtattatcactgtgaacaagtactataccgcacagcggtgtgtatcaaactgtacaactttatgaagttgccgatgttttataactaatagggtatgtgtgataaacccaagccgactttaccagttaatggttgttacaatacaaacgcaacatgctgagactattgaactctcaactgggcaagcgaggcgtagtcgacgatgcgctgtcccatagattactggaaaaatatccgactctgagcattcccaacgtagacttgaccaacagcgaacagtacctcgtcgagagaataattaacaatagacacttttacaatttatgtattgatggaatgtcttgctcgggaaagagtaccgttataaatcgtctaactaaagactattccgcttgcgcttacaagatcaacagcgagctcgagtgcaaagactacaatttcaattcgaccactgcgtttcagtatgcgctcaaacaggctctaaactacaaaaagatgaaacgatgcatcattgaccgatcgattctgtccaatttgacatttcaactagtctactggctcatgtcgtgcgaggactctatgtatgaaaagctgtcgccgcactgcctctgcgtaaactatatacgcatgcatcaaatggagccggtactagagtttatcaaggcccaaaaccacaatgtactgattgtggtcaattccgactttgaaagagtctgccggatgatggtggctcgcggtgccggaggcgacgtctacaagggactcgttcccaagtacgtagcgtctcaataccatgcgtacatctttatggccaacgtgttggagttgcccgtgtttgatcatgcaagagtcgacagcggagtcgactcgtttgaacgattgtacaaaatcacgtctaggatgttttcactgctaacgggtgacgatgacgatttcgatgccgagtttaatttgttggaaatgtcgaatgccaacaatggcaatgatgatgatgtcaataatggtggtagtagcagtagtactggtactggtactggagagggtaccagtgctggcactggatcattcagcacccccatcgccgacaagccttgcatcaaacgatccaaaccgacagaagaggaatggctcgatcgtctagtgtcgttgcagatgaacaagcggtaggtgtagattccaatcaagtgtagtagtaaataataaaatgtaataataaaatgtactaataaaatgtaacaataaaatgtaacaatgaaatgaaataaaatacatgtatgctttttgtaaataaattcaatttttttgtagacatgtatgctattggtgttatcatttgtggtattattgtaggtggaacactatataaataaattgccttgtccatttgcatttagttgcattctggttgcagtagaggtactttaagtagatttaaaatttacaagttgaagtaagaatttcttttagtgcacatacacacaggtacaacgttgcactacaaagtagacagcttagcgttcaagtggaaaataaatttacaactcgtagttgtaaaaattaattaacaactctaaaaaagagatagatacttactacaatgcagacaaactgggaagagcaccaatacttgaacacgatcagaagtatcattgaaactggcaatcgccgcatggatcgcaccaaagtgggcaccctgtctcactttggagtgatgcatcggtactcgttgagggacaacagcctgcctctgttgacgaccaagactgtctttgtcaagggcgtcatcgaggagctcttgtggatgatttccggatcgaccaatgccaacgatctgagccgaaagggtgtacacatttggagcggcaacagtagtcgaagcgttttggattcgctcggcttcaccgacagacaagagggtgatctaggacccgtgtacggattccagtggagacactcgggcaccaagtatgtagactgcgagacagactattcgggtcagggtgttgatcaattgcagacaatcattgacactctcaagaccaatccaatagacaggaggatcgtaatgtgctcatggaatcctgcagatttgcaccaaatggcactaccaccgtgtcactgtttggctcagttttactcgtacgatggcaaattgtcatgcttaatgtatcagaggagtgccgacatgggcctcggtgtaccctttaacattgcaagctactctatgttgacgcacatgattgctcacattaccggcctgaaagcgcacgagttcgtacacaccattggcgacgctcacgtgtatttaaatcacatcgagccattaaaggtgcaactcgaacgggagccgagaccttttcccaagctggagtttgctcgtaaagttgaaaatattgacagttttaagtacgaagattttataataaaaggttacgatccatacccgaagattcccatggttctggctgtttagatgtatgatagatgtgttgttattacactaatgtatccctccaatgtattctagttgtataagcaaagttattacatatttatatcatactctaataaatgttgttttttagtcaaacagagtctatacttttttcatcacctttatccatcaagttgtactctaacaaacctaactccactaaataatattgggtcaaccaacaaacccacctacctccactaaataatattaggccaaccaacaaacctacaccagtgacagtctaaataaaagacaagacattgtaaattgtaaccatttattaaagcaaaatatgtaatgcaatataatacaaaataatgtcatacagtaaagttatagagcatataaaagttgaaagtggttgtacaagaatgtaagtgcagtttaaaacatctttaaaaaccatctttaatgttaatcctcttaaatagtaatcatagtaaccatgttaaatattaaaacactatccataatactaaacatcatcttgagcattaaccatcttaaataatcttaaataatcctaaataataaccatcttaaacatcttgtgtgctaaacttcttgtgtgctaaacatcttgtgtgctaaacatcttaaatattaaatattaaacattaaatattaaacaacttaaatattaaactaaacatctttaatacaaagctaaacattctagacagtaaacagtaaacattaaagtagacagttataacactagacaggcttggaaatcttggacacaaaatgttggccatttattatttattatcaactatagattaattctgacttttagtacatacaagctaaacatttaattaaacatttatacattgagattccgtgtgctgatattgatgttgaacattattatagtgcattaaattttattctaaacatttacacgctacatttaaaatgctgtaaaatacaagtggctttaactacactaatgattacctttttaaagtgctccaaagtacttttaaaaattccaaacatttattggcttcatacatacaacctaccattagtgcctattaggcctgcgtttattaccaccactactactactagtggtagactttgttttggagcgaaaacgtttagatggaccaccaccgtacaaacgacccggcacctttttgatcattttagttgtaggaattttcacagttggaatagtatccattacaaaattgcgtctagtaactattggctccagcggtagcggttcaaactttacaagtattccattggccgacttggtggtcagaggattctcagtggtcgtctttttgggaataaccattattacactggactttgtactagtggatataggtagcactggagtgggtagagttggtaaagttttatcatttctcgagaggttcaactcgtctatagtttttatggaaccatttattggattcaaaattacgggttgtaaaagtgtaaaatttaaaatggagctcaaagttggaggatggtttatagagttgtcaaaatgaaaagcatcgtcaaaattaaaagtatcatttactggactcaatagtgtaacgtttgaatggctccgtgcaacctctggagggagtattgttttcaatattgtcacatttggtgtgcgacgtgaaactggctctataatttgaaggggtatttttgtagtagatttagactcggtattggatacatttatagattcaagagtggtacctttggtgactacacttgggagggtagcatgttggtgaatagcaacagatttgggcgtgactctagtgaccgattcaggctctgtggcagcctttgattcagttgtaaaatctgttacagtgcttgtttgaacagtgccaacacttgttgattgtacgagcacttttagtgtggagagtgcctttagtgtgccgtttgaaattgcttttagggtgctacttccgagtgtagtaaactgtttaaaaggtgttgtagtcagaggtgttgtagttagaggtgttgtagttagaggtgtgggtgttggtgttgttggtgttgttttggtcgttgttgtttttgtaggtgtatgatgattatgtaaagtagtggtagtagtgtgtagagtagtaggtatagtggtatgtaaagtagtatgcagcgtagtatgtaaagtagtaggcaaagtagtatgtagagtaggatgtaaagtactaaatttagagctgcaagtaggtttacaaataatggataaatcctcaagcagagtggataatggaattggctttaaagttgtaggactgggtttaaaggttgtgagatttattgtggtcggtggttgtgtgagaggcggtgtaagaggttgtgtaagtagccgtgttgtagttgcaagtgtaggtttggttgttggatgaggtttagttgtgagatgcttagttgtggtaggtttggttgtaggtatggtgctagtactggttgtatgtttaattgttgtgtgtttaggtgttgtatgtttaactgttgtatgtttatttagcagcgtcaacaatggacccagagttggtaatatctctagcaatggcttcaaaggcttcagtgtaggcaaggtaggcaatggttttatggtaggtcttatagtaggcaatggttttatggtagggaatggcttaagagtaggcaacggtttcagtgttggtagtgtatgtttaccgagagtaggcttgggtttcagtatcgtagtaggtttgggaggattagttgtatgtttgggaggtttgactgtaggtttagttgtaggtttaattgtaggcttagttgtaggtctgattgtaggtctagttacatgcttggttgtagccttatggagagatgttttaagagtagctctactagtaggtttaagcgtaggcttgattgtatacttgagagttgtcctaatagtgggtttgattgtaggtttaagattatatttgattgtagttttaagagtaggtttcagaataggtttaagagtaggcatcgtcggcctgggctttacagtagttttagctctcttcaaggtggtgtaaaatttaggctttactgtagtctgaattctattctttaataatgtagtcgtcttttgtttcattatagatgcagtggtgctagtaattttactacctatagatttggtagtattagtagtagcagtatgaatacgcttgccaaagtttgaatttaatccatccagtttggaatcattaatcgttttattgtccgtatttttagtgtttgtaccaacttggacagttatactggtagatttagcatgtgccttaccagtggatgtattagtctgtttaatgtcagttttagtattgggtagattaccattgacttttggaatagtgtcaactttggatttaaagtttataattggtctagtgtagattggtctagcgttgccagaaagtggtaaggtattgagtctcttaaagtttgaagttgcaacagtcctagtattatttacagcaactctgcgttgaccgtcaaaactatacgtttcctgatctctaacattcaactgaaacttttcactacgcctactgaaatcgttttgttgcaccaaacgtttggcatctgatcgacctctattgctcctagtatttctagtgttggtgttactcgtattgttgatgttgttcctagtagtactattaacaacattaacctccccatcaacatcctctttcaaactacgcctgtatcgtctaaagattgcatgttcactgggttgtttgacgctgctagagtttacaatcaaactactcatgctgtttaaccctcccatgccatttaaatttccacctaaactcgaatgcatgctcttttgaatatcgtccatgatcaagtttagtgttacttttgtataggtctgcaacaatctactaagacgtcggtgtagctttttaaagttggcctcgctgaaactggaaccggtatccggctttctagacaatctatcaataaaactaggcatcattctgtccataaaatttctatccataaaattggaaccgtttgcgtacagtagctctagataggatgcattgttatgattggtagcgttgaaagtatggttatgatttagtgtggcactattgttattattattaggattatttaaactgaaattaaaactattgttaaaactagtagcagtagagtccaaacctgcaaaagtaccagtttcggatccaatgtgcactacgccaccgttgcgataattgtttgcaataaaactagaatcgacatctttaaacttcaactcgtactcgaacgaatccatcaagagtatccgagtcattagcacgacgattgtaaacagcaccagaatcgcaatgagcgatgccacgattgatttgatgaacagcgacgatacctctctgcgtgcgatccattccttgcgagtagtagtcctctttagccagtcgacagcagacgccgccaccgacgatgtaagctccggcggtggcacccgagtctcctcctcctccgtttcggcaccgacagtgttcatcgcaggcgtcgacattgatattatcggagtgtggcactcggtcgccgtctgattgcattcggtacacacaacgtctatgcactggacttgattgtcgtcgcacgagccaaaagttttaaacttgtaatacgacggaatgcgtttgctgcccagattgattcggtgcacattactactactagtgctaccagtactgcactcgtcgtctgaatttaaagttttggcaccagagtccatcctctgagagtgtaataaacttgataaaaaacttgagaaaaacttgagaaaaaacttgtactaataacaacaaaagcaactgctacggtatagtaattaattcaagagagaggggtaaaaggaaaccccttcagtctcggcgtaaggctctctgtgaactgattcccacaggcgaccgctggcacttttaaagcgcggcaatgttaggtattttttagtcacacaggatgcactactaatactaacaataacaagtccaggatgtgatcagttgcagattacaaagagcacacgcgcgccgaacggttgctactagtgtattgaaggcgcgcgcgtgtctaaaacttggtaatcaaacaagtggccaacttgatcaaagcagcactatgaccggtacattagtaacggtccggtactattgttgcggggcgcgaccgtcagcacccttggtcgtgaacaaactgaaattcagaacactgttgtacatcactgtgtaagaattttattaaaagtcttgcatttatttaatcaactctgtttatgcaatgcagctacaatagcgtattgaaagtgtctaaaagtgcacattattgatgaatacacgatggcggtcgcattgtctagaaaacgaaagcgacaccaactcaaggatttaaacacatatttggaagtgaacgagccacgagtcgaaccgcagtcgtgcacgtacttttatgtaggcttcaacaagtaccaaattgtaacgtcaaacaatcccgtcgactatctgattgaatacatcaattcgtgtctgaccgatgtcataggctacattcgagaagagggctttgatctatgcaacaaggcaacgcattctcatatattgacacatttagtgtgcggtatactttcgtacaataaaattctaatgagcaacttttaccgatgcatcgtacacggtccgcttttgatggccgaagcggcaattctagtttatcgcatggataacagcgctgcgctatacgtgtccgatactatgctgcaagactatttggcatcggagagtaacacgactctattattcgattccaagtttgatcagagcgacatctcttcgaccacggtcgatgatattctgaaaaagattccactaaaagtaagcaaaccgagcaagatttacaatcagcaagaggacgcactgtacgacaactctgcgtgcgaggaacgcatacagcgcctgtttggtggaaaggtcgacgacgcaccaatcgcagagagcaagtttatcggcaccctgggcagctacacgggtacgtgccaaatggacgatatcgagtttaaggatcgtctcaccaaaaagaagcaaacctctatactgcacaaactgtttatattggccgatcatgcagttacccactttttggaaaatggaccgaatcactctgaggtgcgaagctttatcacgcactcgggattcggcaccaagaatgtacaaacactgcactcttcgttgaaaattataggcaccgtttcgggtgttaatggcccgggattaatgggatccaccggaggattgtacggaaacggtctgctggccaacgatcacgttaccttgaattatgatgatggtaaattgttgttgtattaaagcaattgtataatttgaagaggaggcggagtagtctataattgcactagtaatttttagtaatttcagtaattggcgtttgatgaattatgcatgtggaaatacattgtaggagtctaacggtgcacctagtctgatgtagtacaatactcagtctgtagccgtgtatttgtatagaacaagtatcaaggtatcaagtatcaagtatcaagcatcaagtatcaagcatcaagcatcaagttttagtttcattcagttggagttatactgttcaactttttgtattttttaaacctattatagatatattatatacctagttgtttcttcaattaataaaactaaataacaaaaataaaatacaataccccaaaccacccactttagtttaactctacaaacaattccataatccatataatttcatttgtgctccagttggcactctgtgtgatgaccggtactgtataatactgcagcgttaaactactcctaccactactactggttgttgcggatactactactacctactattattaaaattacaaaacacaaaaaacagaaatacaaaaaacaaacaacaaaaaacaaacacaaacaaaaaaacagaaaatacaactaaagcctaaaactagtatacctacatcatcatccttctctcgaaaactttaacaattccaagtttatcatttttagttttattaaaacttggaatgtctgcatgatactgtacaaaactatataaaactgtacaaacctgtataaggctatataaaattatagctataaaaaagtccacaccaaatgcaaaattaaatgctaagcaagtaggtacaaaaattctagaaaaatgctagtttataaagtacaagagtcaaggttaacatatataataatatagcacatatgcacacataatatccttggtagtaaaacttttctctcaaaacaaaaggccatgtgtgtatgtgtatgtatgtaggttgatttttatttttatttcagtctttaatacgagtacaattagtagcagtagaatgaacacaatttggtattgggtgctaggaaaacaataaatgacaatagatgaaaaggattacaaagattacaaagcttaaagactacaaatcaaacttaaactaaaacgccgactctccagattcatcattggtaaatttgataaatacatttaccaattcatttgttttgggatcgtactcgtgctgttgtttcaggtcacttatgtaatcgacaatcttttcactcatcgtaatcgaacagtgcttgccaatttcgtgctttaatctgcgcacatttatacggccgccctgtcggtactcaatctgaaatatggattttaaatcactccaagtgtcgtcgtcctttttgtacgaagcgctcttgttgctattgttggcgttgtttgtatagtgtccggtgccgcctatgccatagcacgaaccctcttcgtcttcgaaacctataccaatgtagcgcttcaagtgttcattgtaaaactgtttaaactgcatcctaaactcggacatgtacttggatagcgatatagtcttgttgtaggccgagttgtactcaatcagcttgagactgacattggccatgaggtcctcttcgttgatgctgggcaccgaggtggacgacatggccacattggactgagacggtgaaatcactttaatgttgcacatgtccaacaccttgtacagatagttgtttttcaacataaactcgtacaacagtttggtagagactcggttgatgcactttggcgaaactataccatagtcgttgcgatgctgtctaaagtagacgtacagcagattggagaggagtggtgccatcttggacacttccatttgctccttgtacgtatagttttcggcaaaggttagcatacaattgggatccttgaccacatcggtggccttcatctcaaacaggaatataatgattcgatctcggatggcctcatcgggcatggtcatgtacggcaagtgattgcacgctgccaccagaaaggtgcaactgctcaacatgggaaacttggtcgaaaacagggtacggtcatcgttggtgccatcgtcgcccgtcatcgttttgagcagattgttactgatcgagctcagttcgttgatgatggaaatgtacttggtcttcaagtgtatggcattgggcgagggaccggatgactttacatccttgtactctttggaggttcgatagattgcatcgtcgttgcacatttcagtgtgcaagttgagcagtgtagttttaccacacctgggactgccgtagtaaatattcatatgtttttgcaccttgcacggctggtatagacagcacgtgtacataaagtagtctctcaaaacgtgctcgttgtacttgaacgtttccgagaggaaaacaaagagctctttgtagtgtttgaattcgggtcgacagtgacgaaacacgtacgaccatacacgatcccataggtttagtttgttcttaaagtgagcatcgtcttcggtgagatttgtgtatatttgcatcaaacgatcaacctcatcctgacggcccatgttgataaagttgaaggtggcatcgtccgaatctacaatggtttgactacaatcggttacgcatttactctgagaattgtttctactagagctgggactggcaccagtgtttggattggaattgaaacttttagatggagagttgcctctactggggggtttaggactaccaagactagtaatattactactattattattgttaatatttgtattacttttatttttagattgaaaattgtttatattggcatcatcattatcctcatccccatcctcatccattccctcatagccctccgattctccgaaaccagtcatgtcgagatcgtgcaactctaccagactaacattacccttgatgatgccgatacccttgccagactgttcgaaacctacaacgttaccattggccgcaaacaagactgatcgttccggatgcaatagggaaaagcacaagactcgtgcgttttcgtgaacctgacccagttcggcatcggactgtaccggtatgggatcgtccatgatcgaacccatcagcgtcagtagaatgcaagcattcgccacgatgatgggctcttcggtaatgtcagtgttggtgtcaaacgacaagcgttcgtagcactctttgaccgtgtcgtacgagagctcagtgtcgtaggcctccaacagggccgagatcatacgagccaatgccatggtgtgaccctttagtttggccaacagtgggtgcacgaaaaagtagcaacgctcgttgcgcatagagtcaccctccatgaaatgaaagatggtcaaccatgcccgttcagctagatggtgcgagtagatgctatactccatggttagcaaaccgggcagcatccgagtcaggtagaacaagagacgttgattctttagaaaggtatccaacagacgatagtagtcatcgtacgtctttagcaattgaaagttcataatgtttaaatctttggatccgctcagagtgtgggcacagaagcgcttctccatgttaaagtagagaaacggagtcttgggcagataggtgccggtgattgtgtaaaagactccgtgactagtgttgataaagtaggtgtactcgttgaagcgcatctgtcggttctttagattggcaatgatggtggtgcatgcaatgtccttctctcccttggacatggtgtcaccgatgcccagcaacgactgaatcagacgcaccgtattgcactgtttcagctgggtcacttgttcgtaggccttgttggtgtaattgtaaatgtagcaatcttctccgaaatccatctttatgggaaagcaaattagctttatgattacctcaaaggcctccacactgggaccctctacggcgcccagactaaagacatggttcatcacggccgatacgtactcttgcatagtgttcttttgctttatggaaatctccaagattatatagtctagcagatcgttgtaggtcaacgcaaacgatctggagagttcgttcataatcttgtatcggcgcatgctcttgatgatttcaatcagagactcggtgtgaccgtctcgggagaggaacgtgctcaaatagtcgagtacatcattcttgatggtctcgtcgtcctcggaggacatgctgtcgttgcaacagtacatgatggctacgatcaacaggtacaccgagtactcttcgttttcaatcagagcactgattaggtaggccacgttctctgcgttgggatcatcgcactgcgcaaagtacagactctcggccaggtagcgattgagcgagaccagcgattgctgtatcggtctgaagcgttcgtccaccgtgtccgtatcgagcagagttacgctattctttagacgcaactcgttgcgcatagtcaccacgaaatccaacaactggtacgtggactgtacgctcttgatcgattccagctttagccgacaaatggtgtccaacagggtgggatgttgcctgacttggataatcttgttgttacccacatcgggcagtaccaagtacacgtaattgtgcttgtctatagacttgagcgttacggtaatcttcatcggtttggcctcgtactcgagcagcggtcgactgttggcacccatcgtggtgcgttgctgataccaagagtagtcgtaaaagtattcactcttgccaaaggaaatgtacatgtaagaagaggtcgatgtagagtttgcattcaaagtgcctaccggtgttgttagaacagtgttgtcgttgtggttagttgcggttgtacaaacagtaggcgtatttgtagaatggttacaagtattaggattattaggaacaattggtaaaacattgagatttgtatcaataagagtggtagtagcattgttggtagtaacattgttggtagtagcagcagcactagcagcaggaacactagtagtaacaacatcagtaacagtagcattattgttatcattattattttgcatattatttttaatattagtagtaaaagtagtagaggtagtagtagtagtagcatcactagcagctcttttagatttagacttgggtttgggtttagctgcggccaggtgctcgttgtcgctgcaacccggtggtatgcgcatcgtgtaaacgttgccgtcgctctttgccgagtacggtaacggtaccttgtcaatcttgtcaatcttgtacacgtccgtgtacattggtggcagttgacagtttagcacatcaatcatggtatcgtagagtatgatgctgacatccacattgtagtaaatgtgaacgtttcggtttctggtcattacgaagccgttacgctcacatataccgagtccgggaaagctagcgtccaagactcgtgtaaagtctcggtacatcatcgtcagttgggtaatgggaatctcttcgatgccgtcatcgtccgagggcttcaagtctagatcaaagcaaatcttaaactgataattgtggctcattggtatggccagagtgtggccagactcttcaaagtagtcgcgcaacgtgtccagccggagggcatcgttgcgcactcggaccacctcaccgtttaggcaatcgtacaggcgaaccgaaaaagagtcagtctcctcggcccgattgcactggaggaaccttgtctgatttctggcaatatcttggcagtatgcgctattgtagttgtgatcgtagtctatttgggactcttgcaaaatcactgtaggcgtaggttcatagacaagagaagagtacattttgaatctgggcctcttgttgttgttattacccttgtcatcgttggacttttcatcgttggcaaaacgtttcataatgattagtactatcggtaaatactttgacaagtaccaagtgtttatagtattaggtattgcgataattgcaatagtctatacgttcagtttgttaaaaacatcaaatctcggcaagattatgggctcactcaccgatgaggccaccgactctacaaagtttaacgcatccttctttgagatttacgacaaatccaccgacgactactgcgatcgtctaattctggtgcaaccgttcaattggataattgtggccaaaggtggccagatgtacgccctgaccgatgtgcagcacaagtgtccgccgaccaccacgcgtgccgtcaaactgcactcgaaccaggacaagttcaagtatgtgtgcctgtcgttgaccaagatgcagctgattgagctgtatcgcaatacggcccacaatgtgctcaagcttacgttcgacgtggacgctctgcaatcggacgagaagaggttcaccattttggatgcatgcaactacctgctggcacagggctacgcagtgttggacgtaaaggagggtgaaaaggtggacaacaccaaagcgactaaaccctcggacaaggatgccgaggacgatgctagattcagcattctaaacatgttgcgtggacagaatggcggtacggatagtggcatcaagagtgtagtcattcgtgacggtagcgatgcgagaggtggtttgggagacagtgttggtggtagcttgggaggcagtgttggtagtgtaggaggaggtagtttgggaggtagtttggaaggtagtacaggtagcagtttagaaggcagtttaggaggtaaagagcaatctaaagtagacgatgattccaactccaagattgccagcattattataccttctgatgctaatattgactctgtttcgaatattgagattccctctgttactaatactaagagtgccactgttttgaatactgatgttgcctctatttcttatccatctggctctaatattgcctctatttctaagactgatgttgcctctgcttccaatacatctgattctaatattgactcgggttctaatactaattccaagattgttactgacgctaaatctaatgataaatccaaagacaaaaccaataacaaatccaaagaccaatccaaagatcaatccaaagacaaacccaaagacacgaccgacttcaaagttgatgataaatctgattccgagtccaataccgaatatccaatcaaggtgattgaaattacacaaccaccaccagagaatgtggacactacaaagctagactatagcctactgccaccaccgaaacccattgaagtaacgtacattgatttgagtaaggagcctgactctactggagattccacactacagccaacacaaccacctcctcctacaccgacgcctcctcctacaccgacgccaccttctacaccaccgcctcctcgtacaccgacgccaccttctacaccaccaccgcctcctccaccgacgccaccttctacgccaccgtttgttcctacatacaatccacccggaggtgtggtagagtacgatggagctgccgatttccttgagctgctcgatgaggacgatgcagattttgaagcgataaaatcaaaatccaactctcgcaaaaggcgcgatctgtctgcacagtccaatgatggtgatggtgatgatctaccgccgttcataatcgatccagtcaccggcatcagacgtcgcaaagtgaccaaactgcccaagccgctagaggttgcagcgcccgagtttcgagactttgccgaggagaatttcgatcatgtagagctacccaagggttttgagctaccgctcggagtgagtctcaaattggccaagcgttggcagcaaattctaaactactaccaggacaatggaatgccaacacacagagcgcaagatgcctacgacatgagcgatgccgagtgtagagcaatgggcaaggctctggcgggctactaccatcgcagccacgacccatctaaaccgcccaagtttggaccaccaccgaatccagagattgactctttggtttacaaaacgtattagtttatggagtggtttgtgttgtagtggtttgtgttttagtttccaattctaatttatgtaattcctttaatttctagttttgtatccattttacatgccttgtgtaccactttatgtaccactttatgtaccacttttgtgttttttgaaatgtctttgtattaacaaatttaatagccattataatatttcaccttttttaatcaaaacccaaataagagtacccaaaaaaataactagtctagtttgtataatcgtttattagagagattcaaagagtatgtatacagagtttaagagattcaaagagtaggtagacatggttaagagcttcaaagagtacatagacagaagttttcaagattaaagagcacgtaagccgagttacatagattaaaagagtatatagttacagagtattgaattagagtttcagagtattgctatttcagagtagagaacatgtatatcgagatcctttcataatacaggtttgctttgagattcataaaagattcataatacaggtttgctttgagattcataagagattcataatacaggttattttacaaacaagatattcacacactaactatcctccacgcccatactaaacatcctcatcctccaccccccccctatgccattgaaaacaaatgagtaacagtctgggactctttatagtcaaactcacgatcagtcaaaacattgagcagcttggctagcacctccaattgatcgcgcttcaccagctttggcatcgatcgtagattcttcttgtctgcattgcacttgatgcaaatattgctgacggtaatctcttcgtctccggacctggtctgttgctctatagtcttgaagacgtgatcgcaatcaatgtcaatggtgggaatctcatcgggcctcttttccagaaaacaacccagactatagtgattgtcgtacactttgccggtgtgagtcctaaagtagactcgctgcgtgtccggatcacgataggtcatgcacaacttttcaaactttacacgagagccctccttttcgattcgagtcttgaatcgttcagtgggcaggctaatctcattggtttcgcgttccttttgtagagactcgtgaatcgctacaacactgggatccgatgtcgtaaacgagtacagcactgtagagttgctagtattcaaagagagtctaatgttgacaatcttaaaattggtcttgtactttcggtaggcatccaaagaggccaaccgatacagtgaactattgatggtctcgctattgagcaagtttgaatctatgctaaaatgatcctccagctcgtacacattgagcggattattgtgctgattttgttcagattgcatcttatcagcaaatgttgatttccgctctaaaagtacacaaccgttctcgtacacttgcaaaatgcaaatgataccgtgctttgaagggcttcagcttttatctggccacgggtggttgttttttttcagcctctctacttgctacatttgagctttacgccaatagggtatacgctattgaaattgtgtagaaacgttgatggagctattgcgtgtctggggtacgagtccatttcgtagagagtgagactattagcctatagattcagtccaggtaaaatgccatccaccgccaacactagtcgtaaaacccctaaaccatcatcaaagcgattctccactggtaattttaccaattgggattctccgaatagtggcatcgttaggcttctctccgatgccaagtgtagggtggaatcctacaaagagttgcctcatcgcaaatacaaccagtgcgactacaaacgatggatgtcgcactaccaaccgatgcagtatcgctaccgatgctacctggacattgagcccaccggcaagatgtacgctctcgagtgcggagtcgaagccgtgcccggtatacgggatctgaccgtgctagtggtggactcgacagtggcacaactcaccgacgagcacattcgaagcgtgtacgagcagctcgaagagggtctcgacatacgaaccgattcaatctatgctcgatgcgtcaagagtgtacgcacagatttgcacttgcaagtgtttgacgagctacattcgaggttcggttcgagcatactctacattgcccacaacgggttccagtacgatttcaaaatcatcctggacctgttgaggcgcaacgatcgagcctactggagcgacatggccttctcagactcgttggtcatgatgaagaatcgcaagggtgacgctaaaatctctagctacaccaacagcgctctgttcaagatgattcagagcgactggcaaaactactatctgctgacaaagatgcactcgtccatcggagatgtgctcatgatggccatctggacgacgagtctaggggtttacgaggcgggcagtcgagtcgcagtgtgcaccggtgcacgtttgtgcgacgtctacaaaaaggcggtggctgtgcgcaaaccctccagactcgtcatacgcaatccctttgacaaacgctaatctattgtttttcgaatgcataactcgtacacggtgttgtcggtatctatactggtcagtttagtgatatgcacattgccaaatcatgtttctcaatcccatcacttttggctacaggacgggtgcacagcacgatcctctgcaggatcggtactcgttcaacgtgtaccgtgaacgcaccaagggtcaggtcagtgtagacgccgacaactacctcttcaagtctacttatttttggatcgcaccgtacatgatcaataagcatgcgactccggtaaactttacctttaccgaccgacgacccgagactacaaacgcactcggcagcgtaaagagttctcaaatcggtccagttctgcaaccgcagcagcaacaacagcaccaccaccaacaacaacaacctactcagggacagggtccggctcaggcgctctttgacggtatcggcacttcggacaatgcgatgggctcgattcgtatagtgggacgcaaggcaccggtggtggtgtttcgcgatgtgatcgatttccgagtagacgatcccggcacaatgtccctggccgactatatgcaactaaagcaatcactggaacgtttgaattcactcatccgagacacggacaacgtggtcgacacggctgccgaagaggagcgcatgagggccaccctctaccggttcgccagagagtctagtgtggcgagaaacgaacgcgaatggatacgagtgctaaacgccaactatccagaggcgatggccagactcaacatgtacggtaccgggggagtgttgaacagtgacgatatgcaggtagaggttgataatgcaattgacgagtatgatgcttaggttgtggattattgcgtaaaattatgtgtagtagatttgtaatgattgtttgtatttgtaacgattgcttgtgattctatttttttcaccaacattcaatcgcaaccctcgagtgtggcctcaaaggtatgctctcaaacgcctaccgtgcaaacaatagcaagagtacgggttgcgtgaattttcaacatttgcgtgtgttttgcgcattttcatttttatacagtttgtgcactatagagccaatacggtattggggttatattgtggtgcaagtattatgcggacgggctcatttgaccgtctccgtgatgggtgtgcattttgcacggtacggtgaggtgtagtggtgtgcatgaaatgtgcgcaaaactacactctgtgacatgccgtaatgtgtaaaatgcatcctattgtgaaccccttcggttcaagttttagtttatactttttaaactcgtaattttaacacgaaattgggtacaatttcacgcaatttcagtgcaatttcacgtacatttggtgtgtttgctctgtaaattacgttaggcgttggctaatctggcttaaaacttggtcagaaatcatcaaatttcaccgagtgtgcagatggctcattttgagcactttgcgcactttggtggtaaaatcgacttttgacttgcgtgctgtcctgtttcgcacaggcatgcaaaaacagcgtttttagggcttttgaagatgatactgtagacggtggttttgtgcacttttgacgactttgggtgcaattgctatagcagtaattgcagccatttgtcgtacaagatgcaacaaaagtatcgtactatagtattatttggggggatactatactataatatatattatatatataggtactgggcgccgagttctatttttttcaactcgtttttgttatatttttttaaactcgattactgaattttaaataatactaaaaaatgtaaatgtttatatgtatttatttggtagaataatggtggttacaagtatgtcttacagctaccagtatgtcttacagttaccagtatggtttacagttacaagtatgtcttacggctacatctacaaacatttcttaaactacaagtatacgcacatagaacaacatacaatagcatgcaacaacatacatcaacatacaacaacaatcctcccccgtaaaatctaaatctatcccttgagtttaaacacacatccaatcataagatccaactcgtgcatggcctcctccacttcggcacgcgtagacggagtcagccgatcggtgcgtctgcgcagaaacgtcaactgattgcacatgctgctggtgccggcttgcaggttgtcaaacgacacctcatagatgccatccggcatattgtcatagtgaatcagattcagcgaatcgtccatgttgttgctattctttacgtacaccatgccgttcatgagcttcacatcaaaggtgggaaacttgaacttgaactctttgttgcgataaatgacaatgagtccgtctcgcttaaacttggtggttgcgttcacgtctatggactcttgcaccaggatgcgtttgcagccatcgccaaagtttacatactgctgttgacgattgaacgtggacagaaacttgagcacctcttcgggttcgggcatgaacagttgaccgccgagacgcactcccagcacgtctgtgattatcactgtgggtatgccctcggatgaggattgcgattcctttctgccgttggtgcacatgttctccaattgaaagtacaggttaggaacagtgttgaagattgacgaattaaactgtataaacttgatgttgtcatcctggtagagaaccttgttgggctcggtgcacaccagtttacacttgaaaccatcgtacttgtgtttgtagatgaagctcttactgtcgcgtatctgcaccttgtgaaacttggaaaagactcgacacggcatcttgaagacggaatcgtgcgtggccggttgcaatcggtgcagtacgcacattatgtttgacaccacattggaggcaaaatactgacccagtgtgtctctgagttcgcacaccagtgccgcttcttgcatgcgcagtccgtgaaaatcattgagcacgtctagcgtgtactctacctcgcccgatatgtagtactcgttgccggatccgttgctcctgcactctagactgatgcgaatattgttgttgcgaaacagcacaaacctttgtaccatcgacgagagatcgctcatggatgccgtaaacggtacattctcctctatcgatacggtacgacacatgggaatcacaatcggcgtggccatcgtgccgctcaggtacaagtgtcgggatttggagattacgtgtttgcgctgagatgtggtgccggtgactcgagtgttgtccttaaagtacatgacccacacttcacgatgtggcaagtctacgcgtgcaatgttctttttgatgcactcgccaatgtgagtggaaactggtagtgcaaagtaggtttcgtactccatctcacaattgggattgttctcggtcatggatgcaatgtgtgccagagtcttttgattgggagtttggttttgcttttgattttgatgttgcttttgagtttggttctgaggttgattttgatgttgcttttgaggttgattctgaggttgattttgagtttgattctgatgttgcttttgagtttggttctgagtttgattctgaggttgattccgagttgatttggaatcctgagtctgaggttgttgagctagactcggtttggactctttgggttgtgtctgcttttgcttgggctctttacaatcctttttaaccatctcggtattggatgcactcttgttctttacatttgatgcagagtgcgcactcttggcattattattggactcgatgcccgagcttgaactctttgtgtttgaatttaaactgtttgaatttaaacttgaactctttccactgttggcactctgtgtgctaatggtgctctttccactttgcacactctgtccactaatggtattctttccactctgtccattagtagcactcggtgtactctttccactaccattactaccaatactgctggtagcactctttgcgctaatgttactcttggtactctttgcactaatgttacttttggtgctctttgcactaccaccactaccaccactaccactactaccactactacctacactctttacactgccactgctgacactactctttggactagcgctacctacactcttttcattgctgctctttacacttgtactagttgcactatccgggctcccatcctgtggactctttacgccatcctgtgtgctcagtggactctttaaaccggcactctttgcactagattcaatcgcactcttgattagtgcattcttttgatttgtactcttttgatttacattcttttgatttgtactcttttgaggtagaggactcttttgatgaggtgatgtactcttttgggatgtactcttttgtgtaacactcttgtgtataccactcttttgtaacgtactcttttgaatcgcgatactctttggattcagtaaactcttttgacttggaggattcagagcagaaccggtactctttaaagtgctactattggtgctctttgaactcggctgcacaggcttgggaatctccgagtcctcatcggtggacgattgagtgctatcgaatcgtttaccgaacccgttgccatcgccgaatcctaccgagttgaaattgttgactctcttggcggcaggatgcgcatctgcgtacgcatcctccgaactcgatgacattgaaaagttggcagatctcttcatgatcgctgccggaagtgtactaaaaaataactagaccacctactgaattaaatacttttttctaagccctgaatacgtgcgtgtagtatcacgtacaatgcaataataaatgtgtacaatgataatttcaaaacatgtaaactacatttgtttagtaggtgtttggttttgtatcctcaagataagactggtagttatgagtaagtgtattgtacaattggaggacaaggtcgagtgcaatcaaaactcataacgagttgctaaaaaaatagcctttattgttgggattcaatagattacagaattgaaaggttacagagtgcaatggtgcatttttagtctaaggattattacaagagttgatgtcttatatgctaagagtctacctctaaatctatactctaaaccacactttgttcaatcttgaccctctttgcagcagattccccatcgagtccatcatcctctgccagaacagcctttacgtcaagtttgcgcttttgacaagttccactctcgagttcctccaagcatctcgtctccatcatctttttgcggatgtcgtccatgggaggacgagggtgagtgcgcaacagcttcttgtactcgtcatagttggggtttccgcgatcgattccaccaaagtcaccgatgcccttaaagtcacgctgcaccaattcaaagttgccaacaatcaccttgggtatgaatccgttgagcgatagcgagttggcggacggagtctttctatagtagttgtttccgataaattgatcaccgttcaggatggatctttgcctagagaacggcaacactccactgggaatcttgtccagtgttttacagttgctaatcttccacaggttacgatcaaaggtggagagatcgcgacgacagcccatgtgcacgggacgcaactctttggccaccttgggtgcatcggccggcttggtgtgtgcactcattgcggtacgatcaaccattatgagtttaatcttgagatcgatgctgaggtgtgagtcttgtttctcggcatcgttcaagtctctgagtttggcgatgacaacaccaaactctccggcattgtgagtgtccaatgcgaacggagacacgatgattggggcatcgtcggtcgcctggtctgtgatcacgatgcacgtactcggcaccgtgatgaacacaccggacaatacgactccgcactggtagagtttcatcgagtctacaaacgcagaaggcactcgcaaagtcagagtatcgctatccttggccgtcagcagagcctcatagggacggtccactagacgattcacaaacacggacaccttggatttaccctttttggtcttgatgcccttgaggagcttcttgtagtagtctttgcatttctgaatgctgcactccgagtctacgttcaacaaagtcttgaaagtgcaagaagccattttttattacaagtgtttgagtagtctcagttattaaagcaaagctttacaatgctcgaatctatagaatatcaccgccttttaagggcaataccgtattatcgatatgtttacgtttgaatgttatataaaacactttgcgcgtacggtgtcgatacagtctggcattgttatttgtagtgcaaacacactagtggtagagctatacctatactttagcacgatacctactccatctacatttgcctactctttacctactctttacctactctttacctactttttactaccggtacctacatttacaaaccatgaaacgtagtggagtacacaccattgaaaatgtcaattttggcatgtttaagcgtcctcgtacgatcaagggtgactttgagacggattggtgtgtgctcaaatttaggacctacaaatcggtggcgtgcaatgacttggatcgaaactatatacagtacaagagtcaggtgcactgcataatcaacgagtttaaaaaggaactctttctcaacaaggtcattgaagagtacaccgactatgcactcagccgggctctggacgattcatcgacgttggccaagctcaagggtggacaaaaggtggtaatcgacaatgcaccgaatcgcgatgccactctgcgcaatctgagatgctgccaccgattcaacaatggcgtttgcgcacagtgcaagatgaccaccgaggaggccgaggcatcgtttgtgtctctcaaagagtgcctgtacgttaccaaggatttacgcactctggactcgtacaagcgactcgaagccgaaatggaacacaatgccattaggattcaagaggactgtaaaaagattaaactctctcaggaggacgaatcgattgcacaaaagtacacggatgacattcgtgcatacatgagacactttaagaatcgcactctgctcgagtacctgtgcaatcgcgagtgtaggagttttttgatgatccactatcgagccgagttggactacatcatgagagtgtaccagtttttgagcagcatcaatggtgcgaatcgtttacgagtctacaacaatccccagcctgaggaggcagatgctgacaaggccaaacgcaacaaacccaacaagatggaccatcgcatcagacaaagctacaagcacatgatttactattcaaagaagaacaacaagagttgcctgcatcgattgctcttgtcgtgcaagcgtgaagaggtcaagggtttgttggattttctacacgacaccaaaccgatgaactctctgtacatgcacactcagatttggtcgagcttcatgaacggtctaaacattaccaagaatgaaaagacctttaaagagtacatgaaggcgtacatgcatcgcagatcgttggtcaaaaacatttaccaaactctgaccgatatgaatatggtgccggccaagagcggtttcgtgtacgatctcatgttggacaatcgcggctatagttcggtaaagatttgcatcaaacgcggcgtgcacatgctctcggtgaacggatcctactatcgagagtttagggatctctacaatacggacgttgacgaattggagggagtgcacgtggaacgtacacccatcatgatgaacaagtacggtccggtgattacgacgggaggctctagagcgctgaaatcgtacaacgtggctcgctcctacaagagtctgtttgcccaaaacactaccggcaacttttacaaaaagacgatcgattactatgtacccgctagtgaggtgtaagccaatgtgtttgtgtatgcatgtattgtattgtattgtattgtattgttaagattttaattaaaattactctacaattttgtaatttaattcatgtaaacctgatgttgttttattaaataaatccacttgaacacaatgcgtttagtcttttttcagatgatgtattagatacaatacggtattggtatttgtctttgggtaattattaaagccttagctagtttagcttgaaaatgagtcggaatcctagaatgattgtcaaaagaaacggttcagttgaacgattcgatccatctaaattgtacgctaggatagaaagatgcatgaccatgtccgagccccgattgaccaccgcctttatcaacattgcaggcatcgtggccgatgtcgaaaagggcctgtacgatcgagtctcgacattggagctggacactctgttgtccgaaacttgcgcctccatgtccaccgcgcatccggaccattcgatactcgctgctcgcatagccatgcaggcgctacacaaacgtactcgttccaagttttccgaaacgattcgagacttgtacgaggccaacattgtgccccggtactattttgacttggtacaagagcatgcagacaccttggactcggccattgtagacgatcgcgattttcaatctttgacctattttgcatacaagacgttagagcgtacctatctgataaagctggccgacggtaagatttgcgaacgagtacagcacatgtacatgaggaccgcgctcggtattcacggtcgggatattgaatcggtaatcgaaacgtacaatctactctcgaaccgctactatgtacattcgacgcctactctgtgtcatgcggcaacgaatcgttccaactatgcctcttgctatctgctcgaactcaaagaggacagcatcggtggcgttatggacacgctaaaggacgcggccaccatttcaaaacactgtggcggtgtaggtttgcatgtgcacaagctgcgctgtaaaaactctacgattcattcaacaaacggcaacgccagtggcctagtgccaatgctcagaatgtacaatgcaatgtcacgatacgttacacagggcggcaataaacggccaggcgctatagccgtctacttggaaccttggcacgcggacgtttttgactttatcgagatgcgcaaaaactcgggctttgaagaggcacgagccagggacttgttttatgcactctgggtgccagatttgttcatgaagcgcgtcaacgacggtggctactggagcctaatgtgccccgactcgtcacccggtctgtccgattgctggggcgaagagtttgaggccaagtacacggcctacgagcaagagggtcgatacgtgagacgagtcgatgcacgagaactgtggaaggccatcgtgacggctcaggtagagactggaactccgtacattctctacaaggataccgtgaatcgcaacagcaaccaacgccacttgggcaccatcaagggctccaatctgtgcacggaaattgtagagtacgcctctccggacgagacggcagtttgcgttctggcatcggtcaatctgcccaagtttgtagagggtaaagtgtttaatctcaacctattggcaaagacggtgcgtctggtgactaggaatctaaacaagattatcgacaatgcactctatcccattccctcggcggccaagtcaaactttaagcaccgacccatcggtataggagtgcaaggctacgcagacgctctggccatgatgggtatagcctacgaggactcggtgcagttgaatcgtgacattttcgaaaccatctaccatgcagcgctgacggagagctgccaactggccagagtgcacggagtctacgaatcgtaccacggcagcccgaccagtcgtggagagttgcacttcgaccgatactcggtgcacagccaaaagtgtgactggtcatcgttgcgcaaagacattgctcggtacggtttgagaaactctttgctggtggcaccgatgcccacggctaccacttcccaagtgtttggcaatgctgaatcttttgaaccgttcacgtcaaacatgtaccagagacgcacccagtctggagagtttcaattgaccaacgtgcacttggttcgagacttggaacggctcaatctgtggaacgatgacatggcccagttgatcatgtacaacaatgggtccattcaaaacattaccatcatcccggaagagttgcgcagaatctacaagactgtctgggagattccgaccaagacgctaatcgatatggctgccgacagaggtgcctacattgaccagagtcaatcgttcaatctgtacgttgccgaacccacctacagtcgtatgacttcgatacacttttacgcatggaacaagggtctcaagacgggcatgtactatctgagaacaaagtcggccaccaatgccataccatttacggtggacgtgaatcgttgtgccttgttgatgagtcaaatgaaggctggcagggttatggcttcaccgtttaccaagtctttgttggtggttgagggtagtagtggtagtgttgagagtactactactggtaatagtgctagtagtaacagtactactagtaacagtactagtagtagcaatcctagcagcaatcctagtagcactggaacaaagcgcaaccttagtcgtaccatgcgctctaaacgttcactgcatcacattacgtttatgcaacagattgcagagaatccaaccaaggcgccactaaaggctaaaattgatgcagcaaattctgttgagaatttaagtaaacgcaaagagccttcctttgagttggtcgatagtgatgctaaaaagatttgcatggatattgatgataaatcaaaggatgatgaaaccaattctcaaatgtgtcaactagagccaaagccaacagaggtaaacgaatcaatagagccaaaggaatcaatagagttgactggacgcaatcaaatggtttgttttgatgatgtgtgtacgtcgtgttcttgttagaaaggttttgtaatttgtagagttggtttatatggttgtagagtttagtagtttaaaaaacatttaaaaaacatttaaaaccagttaaaaattgttatgtttaaaaaatatacatgaattatttagttgatggatatacatacagggttaattataaggtagatgattgtacaagtggtttgtgtacatgtacttgtaaggtattctagtataaggcattctataaggatgtagacatttaaacaatctatgcttgtaataaattgtttaataaacttgtttaataaacttgtttaataaaaactaaaatacttgttgttttttagactctgatttaattcaattcaatccaatccaatccaattcaaaacaatacaatacacacacctccctccctccccatcaaaacccagtcacaatataggtaatcttgctgaccacgttcgatagagcacaagcatcgtgaaacttttcaatcttggatcccaacacttgactcttgttggtgtctagaattataacgttatagtgttgttgttgctgctgagtggttttgattagtttcttgatggtcgtgcccagagtacggtagccattgttggatggatacattctaatgtacatggacgacggacacagtttggtacgttcgggcacattggaaacgtgcaagagtatggtgtcggtgcacttgcgtgcatgtcttagcgcaatagtagcgatgctcttcacgttgtccggcttgacaaactctaagtccataggcatgatgattaatggcacatttcataatggcaaccttggactattgtaataacacattgtcactatcgtgctaacggaaacgtttggtgccatgaaacgacttgagccgtattcagtatataattggaaaattgcaaggtatagtattttacaaaaacaatggacaattgtaaagatgtcgtaaatgccaggagtcatctgtacaacaacgaaggcaacagtctcagaccgtactactatctgtttgagcgcagcgatgaacgcggtctctttaggttaaggttaaactacaaatatcacaagattcgtcaaaagcattacataaggttcaccaaacagagccgaggcttcagcaacgagtacattagtcaatccaacttaatgtccctattcaagattgccatgtttgaatttctaggtaggtacattgtaaacgtaggcagcatagtttcaatcaatcgtaaacgcatacagtctacaaccgtggacctgggggagcaagacgattgcggtcacgtctggtatcagggattcatgtattccggctatgaaacagtttacgatccgctaatgtcgctgcctcagtcgtcggagcccacttggatttccgattgtgcaccaatcgtaaaaatcgttcattcgttgccggagagtgtcaacattttgagtttttgcaagtttgtaagaagcgtcctattcgacgaggacgacgacgccatcatagcaatgaattacccaatagttagaatggttcaaatcaccaatgagatattgcgggtatacaatctaattagaataaagggcaacttgaacgaatctttagagtatctaaacgcgtcaataacgcccactttgtacgatctagagtttacaataggtctgatgcgatggagaaaaagcagctaagcctacaagagtacgacactgagcagccaactcacgatctgccacaggtgcacatttacgctgcagtgtcgtgcaaccacaccatagactcgatgttcaaccagagcataacttgcaactatcagtatattgttctgggcaatcagttgatgttgtttcacgtaatctacttcaagtacgggtgctctaggcagttgctcaaagactgcaccaattcgaatcgagtccagtaccgtctaaacatgaagggtgaagtggaacgcatctacgagagcctatcgtgtccggtgctgtgtagtgcagctcaactgcagccggcatcgtccaccgttgtgggagtgctgctggacagtatgctgatgcaaaacctaaagttgctcttttccaattgtacacacgcactgctcaacaagagtcccaaactctacttggagaatgcggtgcacgtaaacggtacgagtgcactgtttctcttcaacaacatgatcaaggtggagaaaaactttacggtcgcactcaaggcgttcatcaagaatatcaacaatttgattaaacagtttttgtttgtgaaaaagagtacaggcagtagtagtagcagtagtaacgccaatgctaaaaatgccaacaatagtgcagtcataaagtcggcagtgtatccgtgccatgttaccaattcgtgcaagtttaaacagatgcgtaccaagtttgaatcgtacgatcacaccagtgtgcatgctgcactatgtacagccgacgccacactagttggtaaattttccaatttggaatatctaattctgttgaatgaaacccggacggtatttgaagaggtgcgaaatgtgttgcatgtattggattgagagaaagcgagtaccgtttaatgcaggttttgtgtaagaggttttgtgtaagaggttaatgtagcaggaggttttatgtaggcggttaatgtagcaggaggttttatgtaggcaggaggttttatagaatagagtttaagtctatttaggaggcatctctgtatagcatccgatactaaaggaggattaatgtcaagaatctaatgtcgagaacctcaacttgctggatgtatgggtgtctgtatggatgtatggatttatgtgtatatgtatttttgcatgtaaataaaggagttttaaataaaagattgtaatataaagtcaagtagattttaatgtaatagtgtagtttagtacaattggttgttataatctaacaagtaataatgtaattgtataaatcctagttttagttttttaaacactacatttgattatattttattaaacaacatttggatattaaaaaataagaatgaatattacaagaatataaaactacagaatataaacacaagaatataaaactaaagaatataaaactaaaggatacaaaactaacgaatataaacctacagaatataaaaccatagctaccataacactaagcaatcctcctcctcctcaatcatccatcccaacattgacatcatcatcgtactcgtcctctccgtcaccgtccaagtctccgtcaccgtctccgtccatgtcgtcctccaaatcagaggcctccgattcggcttctagcttttccaaattaccatcaacatcactgtcacactcttcagatttgacacttgcattgtcatccgaataatgctgctgttcattgtagtcggcatcttcaacctcagacttgatgtccttttcagttttaatctcagacttgggctcacactttgtcacatccgactcgtcaatctcagaacctgaacctcctctgtccaactccgagtccaaatcactactgttgtcatcgtcgtcggtaaatcttaatatggactcgtactcggaatccgagtctagatccaccggtgcctcgttgctcttggatcgtttaggcttgtgttggtggtcatcttccagtttgcgtttaatgctaccggtactgttgcttctgaccacatcctttttagcatcctttgttgttttacactctttgtggccatccttcaattgcttgtgtttagccttaccaaacaatgcagcacccttactcttggtctttttgcacttttcaatcaatgcaaaggcgccctcctcgtctcggcctttcgcttcaactttggtaacagcactaccatcgacattactaccactattgctactactgctgctactactatccacactaacactacttccatcaccaccaccaccgcctccctgtactgccttcaagtctgggctcagattcaagtgcacgtggcccagtttgattagatccagtacaaaggcgttctcgttgatgctctcgttgagcggatactgcttggacatgagattcatcgtggcaatcaggccattggccacgaaaccattctcggccgtcatcagatcgttcttgggaaacatttgcttgcacttggcattggcctcgatctggtgcacgaaaaaggccaacggggcacaaatctcaccgtcaccgttcaccgccaagtctggactgttgagcatgctcagcgtctgcgacgacgttgtgcgtcccaccagagattgtttgctaaacaatatctgcggatgaaccatctttccggacgcggtccaaaactgatactgcgacagatccttcaccgaagacacgatgcccttttgtccgtgcagattggccaacttggtgccaacgcccaaacgttccgtatagtggtagtggatggagatcatcgacttttgattggtattgttgatttgaaagaaagagtctatagtcttggatttgcgcagtggatcactcattgtaattagatatctaaaagtgttctttataaaagacttgtgtatatagactgatctgcgtcgctgtatccgtacctggtggtctgtgatgagcactccaaacacaatgactccgtcaaactttttattgatcggtatatacttgtaggtgccgttgggtttcagagacatggccttgtgcgaaaaggtggacttgtcgtcagtgtgagcgtacaccctcagcagtagagtcaccgaaaacagtttgagtggcgagttgcgatgaaagttttcatctataatgatgccatcctctacactgtcacagttgaggttgcacagggccgtgtacaagagcatacggttcgtgttcgagtacgtgtccaggttcatttgcatgcactcttcgtaccgagactcgtctcgtttgctggtactccccggcggtacgggtagcacattgtagtcttgcatcttgattgtgctcaactgacgctgaatgcactcaaagtgttcatcggcatcgtgcacaaacaagtctcggtagcattgaccctcctcctcaaaggtcttggcacccaccatgcaaggatccaataaatcggcccggccatcggttatggccaagttttcacgcttcagcctattgtagtctttgaaaaactcgtgcaccgtctcgggagcctccatatagtactctttgcactcgggctgaatctcggccaaatgggtaaactttgtggccgccgccttgatggccagcataaacttggaggaatcgttaaagctgacgcactcaaactcttcgcccaattgacgttcgttttctcggtcgtcgtcgcaatcggtcagcatgccaatattggtggtcatcacggcagagttggtaaatccgatcgagtggatgaatgcgtgcagatcggatcgactcgtcagcgtagagcacgaacccttgatgttgttgatggagacggtggcctttgccggtggcatgtgcaacagggctcgatgaaagttcatcgcaaacgtagtgtaggccgcaaacgatgtgtagccctcaaaggcgtctcggtaagtgttcatggcctcgtgcacacccacaaacatgcgatacttgggcgaatactttaccggcaagtggcccacatggtacacgaccagatagcgatcctcgtacaccatggtcaccacgatcatggctcgcttcatttcgatgacatcgcacggccgaatacgatagttggtgagccagccctcgatcactacgcgcaactctgcctctggactgtggtggtcgttcaaaaagtctacgatccgctccagtgaaacggccggtgcaatcattacaaactgcgctagagccatcgtctcgccggcattcttcatctccttgacgttgagcggacatataaagttggacgagtcccgtggcagtttgagtgcgttcgagtttttcacaccgtgattaatgtgtcgctttaccgtactgatgagtttgtcgatcatcgacactcggtggccctccaccgacaggtaggcagtcttgaactcgtcattcttgatgtagctcaccgtctttgaggatagcgtgtaaaacagattgcccgacaccagagtgcccagtttggaagagttttgcggtagagtgctccatttcttgatggcagtctcaaagatggaggtcggtgtgattatagtcttgttgcacaaatcgtccagctctggatagttgttgatgctgcactcaaaaaaatcaatataatcctctggagtcacagtgtgtgcattgtcagtgattgcgttcaccggacttagacgatttatgagtgcaaagatttcctcatcggtattgtcggccactatgcaatcgtccttgatggcatagcctcggactcctacgcgcttttccgtcattcgtttcgtgctcaccagcttgactcgagtgttgaccgccgcaatcgtagagttgcccttgcgtctgcgcctactacccgattccacgacgggcgattcggccacattgggtggatactgaatcatgtgcacaatggtactgttggcatcgtcgggcacgtcctcgttgagataccacttgtactcgttgctcggtcggtacacgtggccgcatcgcagattgttggtgatgaaggccggtaaaatcttgatgcctccgttcaaaacaaaggctcccagctgatgcttaaagtccacattgggcctaatcatcatgtcaatcttggagccaatcattatcggcaagaccttgtgcttgacgatcacttgattgttgctacagtgcaattggatgcatgcagcataagatttgttgtactttaacaagagccgaatcacatcttcgccgtctacgcgcttagactcttcgtagacgtactcgttgtagcaaggacaattgtagattatcaatttgtccatttttaggttgtactcgtcaacaatggtttttgcgtaaaaatccatgtttgctgctgaacgctaaaaagcgtgttaccgcttcaaatgttcaaccgcttactaataaccgactgttgatattacgctatttatactattgagactatgggcgttgtcattgtttatagatttagcggaaatcatgttctgttcaactagctcgcagtcgggcgctcagcggtgcatttttcaaaatgtatacgtcagatgcactctaccggtggcgggaatcatttgcaacccccatctgaatctgttgttttcgatgagtctggtcaagaatcgggtcgtcatcaacaatgtggccaagaccaaagtgtacatggctccgactcccaatctgaggggtgacaacaaactgattccgttcccgtactcggtgtcggagggcagagtgtgccgatcgccatccatcgaaaatataatctcagagatgcaggcatgggtgagccggctcgatgtggatcaggcttctgcttgtcatctgactcagattctgacggtaatgtttaccgagaacctgattgcatctcaagacatgagtcgcaactcggacaacatgtacctgaaccagtatcgcgactacatgcagtacattcacaagtatgacaaatcgctcaattctagatttgccaacactcgcatctttgcctacagccgaaacggatccatagagatgagcatgacgctgatgcctcagattataaagattttactcttcaactgtgaagcgtcgaccaactacattccggaggctacatcgtttccgcccaatctgtacctggatttggatgcgagagccttcaagttgatcaatcacgatatcgtggccaatccgattgcctactatgacgtgaaccgagacactgatgtagcgtctccgctagtgtttgccggtgatgctcgcgacgacgtcaatgtgctcttttcacgcaacctggtcaactttagagtgtccgaggttggaatcgcattgtgttcgtcttaggtgtgtgtttgtgtttgtgtttgtggttgtttgtatttgattgtatttatttgtagttagaatactagaatagaatatcaaatattattatagaatagatggtattttcaatagtatagaaatgtaatagtgtagaatatcaaatagtgtagaatatccaatagtgtagagtattcaagtaaaagtttaagcaactgtcaagtgtacattttttaaccaattcaaactcttggtcaatcaaaactcgtagtcaatattcaaaactcttcttcaaccaaaactcttggtcaccatccaaaaccctctcattccacattcaatcaaaacctcacattcaatcaaacccttacactcaatcaaaacctcacattcaatcaaaccctctcattccacattcaaactaaatgtaattgtagaataaaaaataattgccgcatgtaggaatgtaaacttgattgcagtatgtagcacaggaagtgtactgattgaaaaactttatagcttaaccgagtttaatttttttaatcttgatacatagatggatgagaaaagatgcaatatctactgcctgcactcttggcactcgtaatgtgtcttgtattttactttcaacttggcacagttggctgtgatggtaacactaccaaaaacaacaacaacaaagacaacaccaccaacaccactaagaatagagcaactctcaagacgggactagaatatggtaagcgcaagagcaactgttcagtggacaaggtgtattgtttcaccgatgcacaatgcctcaactcgtgcatggaaaagatgaatcacttgtacgattgtataaacggcatctgtgaaatatccatcaatagactcaaggagactgccatagttcagggtgagccgtgcaacactgaaaagggcatgttcacctttataatgggtgatccagcaatgggttcgtacatgagatcgtgtaaatccgtcgatttgggtattgcaatttcaaacacggaaaacttgatgtgcaagggcgaccccagtgccgtcatcaactaccactctgcgtatcccatcatggacgactgtaccgactgcaagcaaccgatagtcataccggcaacgtacaacaagcgcagacataaagagtgcaacaatcccttttatcgcatggtggagcacgaaaccaaactgtacgaggaacaaggattggcataaatggagacattaccgtttgcataaatacttgacggatacgtaaaagtcccacatagtttagaaatttgcataaatgtgtaaatttacaatttaattgccatgctagaaatccaatctaaattttagactttgtatgattataggtgcacaacttcctgtaatgttggttagcgatggttattttttcaactttgtaaaaaatgaaggggaccctctaggcttattttttaatttctctaggctattaaattgcggttaattcatagaaaccggttgaataaaacattgaaattaaccactttgtgcaggttttagttttttttgattaaaaaacatgaaaaatgtcagtttagtttattgaatttacttgaactcctacttcttgattaaaaaaatcaaacaaatacacaaatacttgtaaatcattacattattacaaagcacacacactaatcatttccaagatttaacgatcttggtcaacaatagatgaccattagtcacagtctttgagtcatttgacccaaacatcgttaaatagcacgtcttcgatcgtctttgtcttaaattcaaatgaatttttgcacttttcaaagattttcaaaaatgccatgaaattcatgtgcgccaaaatttcttgacgactaagaacacccaaagtggtggtgtcttgcactacaaatgcaatattcttcttgtttgtattcaaaaaagtcgtcaaccactggttggacacgtgtcgatatctgtagagtttaccctccagtcggattgcgttgatttttctacctccactgggctttgtactgagtaccgtccgttgattcgggccctttgtcttggaatagatgcgtatggcaataaagtctgggtaggcttctatcaatgccacctcatcgtatcgtttcagttccgaatgcggaaccagttcaccagtgttttgattgataaaactcatagtttgtaggtttttattaatgtttacactacacacactgcaccgactgatgtgtgcgcatactagtgagtgtaagtttagcgtacgtataggttggatctctgtgagcgtccgtcaaataaattaccgagcaagtgcagctaatcagccagtcttgttcaagttctctattgaaagagtgcggtcgcgatagtctttatagtgtaagctcgttgcatctgaaaactacaatacgttatatgtgcgaggtattataatgggttacacgccgatcaagtccaagaggaaggatggtcttagattttttgatgatattggcggtcgtggtactgctcttgttgacggtgacatttataagatgcgtcaacctaatggttcgattgcacattttgatcctgatgagctcgaacgagagctatctcgagtaccagactgcaactgttactggtgcaaatgtcgccgctaccccaccgacgccgccgccgacgccaagggacgagatggagctgctcaaggagtggagtttatcgtaaacggttagtgttttaatgatgattttccgaatgtcagtcatggctcaaaagtaggtcaaggtcaagaaattgggtcagtgaactgtatagtatatgtagcaagtgtacacgtatggaatgtagggttttttggttttatttagacatggcattcaattttatgcacttgtatagattgggatttattggcaatttcaaatggttttataggggtaaagactggtaacggaggatggcaaaggatggaatgtgtaggattatgtgtaggaatttgcgtgtaaggttgtgtgtaggggtgtgtgtaggattgtaggtgtaggattgattttaggattgagtataggattgagtttaggattaatgattaaatgtacaatgttggatttttacaattgtgtttttattaatgtaaagagtttatacatctctctaagacctttttatattttcatccttttatccaaaggtattgtgtgtttttatcaagtaaagtacaagcttgtataaagtactaacaattgaattctctctctcacgcaggcaccaaacttgacggtaccggagtggtctgtccctgtacgatggatcaaaacgcttggattagtcaacatgcgttgatggggcagcaaaagggtcccagtgatcaaccgactctgatggatcaacaacaccagcaacagcaatccatcaagaacccgactgagccgcctctaccgtcttcggccagctactactattactattattactactactatctgaaccagcactacaataatggcaccctaccattctgtggagatgatgtcaattttaaaaatttgacaacaactgcaacggctaccagtggtggtaatatcaatgccaatgcaaatatcaacaatacaaacatcaacaccaataacggcaccaatatcaacactaatcctactacaaccaacaacccttactctttttcttctaccaccaatctactgtgcaatgaaaagtttattgaagacgaagagattgatccggtagagttggacgacaccaccaaccaagtctacattccgattcatgtcaatccggccaatagtgtgactgtgactgcgctcaaacccaagagagtgcacaagggtaaacgcaccaccaccaccaccggatccggtaagaagcgtcaattcaatctaatcatgctgaccacgctgtacattacgtctcgtttgttttccgtggcaatgggacaagaggtgttgcctgcatccgaagccactccggcctcctctgaagctacgcctcaatctgaagctacaccggccactcaacccacaccggctactcagcctacatcgacttcaccgtcgtctgaagctacaccggcatcgtccgagacaccgccatctgaagctacacaagcctcctctacaccggcctcttctgaacctacaccggcatctccggcatcagaaacgtctacagcaaccaccggtgcaagcaccagtgccagtaccagtaccagtaccaatcccaacaccagtactggaacaataactacaacaccaagaggcacaactgttacaacttcaagaggcacaacaaacccagcgactacatccgctaaccccataactgcatcggccattccaaatccaatcaccatgtccccgatgccgactagcacggaatctcaaatgacaacattcatcattgtgttgcctcaccatactacaactacacccagctataataccgaggccactgctaccgtggtgattgtatcttgtgatatcagagatttcccttggttgactcgtaaactggccatagacatgtttatgaacggctacacggaccagccaaggagtagccgcatcgattcgatcgttagctttataatggatccgtttctttcaccgactccacgcaggagtgtcgtaaacaagattccctgtatgcaactcgtaaaggatgtcataaatatgaaatatggtcctcgcgaaggctaacattaacaacactggcaacatcttcttctcctccttttatgcagacatggctatgaattttggaccaagaatagatttagatttcatgtttttagaatgtatgtagatgcatgcagatgcatacatttttttttaacattttataaacttgatattttacattttttacacattttataacatggtggtgggattggtagctttaggttttggtggtggattttgattgtttattcatcagggatttttatagatttttcttagatttagttgctctaggactcggtctaggactcggtctctagagtttttttaaacatttaatcattgtggtggtggcctaggaataaatgcataatcagtggcgtggtggtactggattacaacattattattacatttattttttagttgtctggtttaaacatttgcaatattattttataacatttgcaatattattttataatacagttgaaatcatataggttagaggtgtaaggttatatataaaattgaaaaatcttggtatagggatttggtactttttccatagtaataattgaacatgcatgtgtgttttacataatatttaaaagcaatacagatttaattgaaccatagggtgtaagattgtaatatgaaacattcatacagatgtatcttgcttggatttgtagatggtttttacacgagaccgtttatccaacatgcatacacaataatcatacacatttgtacaagtatgtgatttttctgtttaacgataatttaggctgtagaatcatcgtaagaagtaaaacttgacacgaacaattgtacacacacaagacgattgttttttaatataaatactagagcaaagaggttttctcaagtacagtctagctactactactatctctaaattgtagtctaaaaaatagaatctttggcagttttaaactctttggcacctttagcatctttattagactcttggcttgtgtttctcaatttaggtttaattgccggtttatttacacatttagttttattcaaacatttagagtttatttaaacattcaagttttaattgaacgttaagttttaattgtgtgttcaggtttaattgcacattaaagctctaacgtcgattttaggtttaaacggcatcaacagcaacagctctctgtgtaatgttttttattcagcatagtggtatcaatatttataatttatgatttataatttgtacaatacttttatatataatttgtagaatattttatatatacatatcagtatttaaatgatgtaatttttgagccccagaatgtgtttctttttttgataggtgatgatgggatacagtaggtgtataagaaataccattacatgttttttataagaatagttgagagtatagaatagttgagaatataataatcctagcgtaatttacaattagtggtagtgtaagaatctacatttcaatttccaacctgcaaactctcaccatcttgcatctcctctgtccaacatcagacactctattttgcacattatcgtacaggtacacgggacaacgcaattgattcaagtggagaagatggtagagtttagactagtatagttagaattgagtgtacaataggatgaaatacgtagtaggaataggtagggttaggttagtgttagtttagtgcttaggaacttgagcttgaattgaaccaggatacactagcacggtcatggaaactaatattgctgctgctgcaactgtagcgagtgtaatgtgtagttggttgtaggatatataaaggtttagttgtaaggtttagttgtaaggtttagatgtaaggtgtgtgtgcatgtatatcggtagagtatatttggtcgcatagatttagattttatatattcaaatcaatattcaacttgctttcaatcaacttgctttcaattaacattcaacgcatcattcacgccaatagtcattttagcagtaaacctcaaatcccatcaaaatcatcagacccatcaaagtcaccaggcatcaaatcaaaattcctccatgaaagatggcagttttatatcccaccgagggtgtgctaatgttgaattttacgacatcgtaagagtttaaagtaacaacactttaatgtaatatgccagtaatatgccacaagttgtaatgtgatacaagtagcagtactggtagtttacttattgatggttataagatgattatttatgttgtatcataatgggctaaagttaattagttttcaccaagacctgtaagcttgaaccgtaataaatgcaaaccttacaagccatataaaatttacatttaacaatttatttagttgaaatttacatttacatacaatttatttagtgctataactattttggcatacattacgagctgtgattatctgtagactgcacgcatcctttaatgtgtattagtttgtagtgcttagcaataactggtagatttctcgtaaaattgtacaataaaaagcattccagattgctgtctagattggctttttaattgtacactttaccactttgatgcatacatttggtttaatattctcttcaatttgcaatttaattaatgttcaatttagtatgtaattgtgtattgtaaagtgttgattaatacaagttcaagtgcaaaggttcaagtgtataaagcgaaagaaggcgcatttcatataccaacaggaacactggtatacctatagacttttttaaaagcaagtggtttcagtgcgagtgtgtacatgtggacatttaccatggagtgtgttggaatcgttgatcctagtacatgtatttggcagtagtttttcgtcttgacaatcccctatagtgttgtaagagtgtgatttagaattactacatgtatagatggatagtatactacatagttgtatgttagcgtatgttagcatggatagttttagtttccaaattgtagttcctcttagtttttaatgttgacatagatttccaattaagtaagttccaattaagtaagttccaatttagtaagttccaattaagtaatttttaaagtagagcaacacggtaggttaatgttgattttttcaatagtattggcagtgggtagtttaaaagtttaaaagtttagttttgattcactttaaggtacagcgtgtttattttaaggtatagtgtgtttattaaatgtttggtttattttaagatttagcttgtgtaagttttacaggtaaaataagtggaatagtgtaagcaccagcataagaagtagtgtcgatttatatagtgcttccatttagtatgcaacttgtaatttgtagattttgtacaatttgtaaattttgtacaatttgtaaaatgtagcatagtttttgaatctgcgtattaggtcaaccttggattgctatttatttatattgtaaggcttttaattgtattgactatttaattgtatagaatcgtgtatttagtatagtagtagcattagtagcattagtagtattggtaagcagttccccaatctatcccaacggtatttattcggcagtagttgcattggcatctagtagcattagttgtactagtagtagttgcattggtagtagtgtactagtagttgtacgagtactagtagttagtagtaggtaattcccacgcatccgagtattgagagagcccagaatacatctatacttaacagcaataagagaataaattgcaacaatcagatgcaccaataatctgaaccatcagaaataataatcaagcataacaagtactagtttaagccttgtaaaaagtgtagctaagcagtaaacacttgactgtgataataaatgttagtataagcattctaaagttaatgtttaggtttaaggaggcttagaggtagggaggtaagtaggtaggtagtaggtagagagactggtgtttagtttaagtttggtttaggttaaaatttacactttatagatttacacatagtatagttggatttgaacatagtataattagatttacacatagtatgatttacacatagtatagttgctaaaaaatacaaaatccaataaaaatcataaaatgtaagaaaccccaaaaacaatacaaaatccttgaaaatgcacataaaaattgtaaaagcataaaacacaaaaacattcaaatgagaggtcaattgcacatgtagagttaagcgcatcgttttgttttaatttaagcatagcatgtagtggcacacacttttgttgtaaaatgtaaaggcggtaatacaacaacacaataaattgatgtaatgcatcataaactagcaagtaaaataggtagataaaacagcatgtaaatagcgtgtaaggtagctcaagtaccatgtaagtagcccataacttagcaaataaattagcaagtaggagttttgtcgtttcttttatcacccatcccagaatttcaataatgcaaaataatggcactcgtatactataaaagccatctgtatcatgttatagcagcagcaaggacagtagtaaactgcaaaagtcgtctcagtcgagtttgtataaatgcgaatgtaacacgcgtttgttcaacaatattcagttgtctgataaatgaaatatcgtattagacttgtacaatttacgtgttttatagtatttgtgcaacatggatccggtcataaagagcaccctggactcttatattgaaacttgcgattacatatcgctggatacggtcgtcttgttgatgaccaacaaagactttaccctggatcggctgattagtgtctttgaggccaacgaagcgggtccgtctacgcacgatttcatacatcacgaagtgacaccgttcgaggtgagagcctacctcaggcgcaaacagtgcgtaaacgttagacgtggtctaatcacagacgacctgaaacggtggttcgatacggttcagagaatcagtggcagtataacgaatcgtaaagcgtttgaactggccgtgctgtttaaactgtttcccaagtactcgatggactacaacataccgcacatgctcagcgacctggcatcgtatacgagccttaaagagtttttagaatttatgcacgaagttgactcttgccgattgaccacgatcaatagtaagctactgcaaatctttgaaatgcaatacatcgatcaggtgattgctcacttgatgggcgacgaagactgcaactattacgtgaacctgaacgaggtacgtgcctacaaggactcgttggtggcctttttgaagctcaccaaagccaaacgcaaaccgacacatgtgcgtgaaatggttagattgtcacacagcatggacaggagcatcgtaaacactgtgctcttggtactgttcaagagcatcgaaaagccaggcttgaagaccaactttttcctaaagtgcatcttgttgtaagaatatggttgtaagaatatagttgtaagaatatagttgtaaatctatacttgtattaataaatctataggtagatgggtatgtaaagtgagagtgtaaactattcattgtttgccacacggtcattaactaatcatttccttgtatttaaatgtctatatacttgtacttgttaatctagttttttgaataaatagtaaacatagatagtaactgctaaggataaatagcaactgtctgagcaaacatggacctcgaatatctactgaccaaactcaactgcatcaccaaagtggaagattccgactatgggctagtggaccgattcaagctggcacaattgggctacctgttgttgattgcacgtcaagacggcggcaagtgtaatcatgtcgattttgaaagtcgcatgtttatccacgacacactgcacgtggtgcaactcggtgagatttgccaagaatgcatgagtctagcgatgcacgacaaattggtccgagtcaaactatcgaaaatgtacaagtcatcgtcggtgcccaacatgaagagtatcgagcgtcctccggtgataccgtttggcagtggctacagacgcagcaatgtctggaagaatagagtttagttttatactaatgtaaaaagtgtacatttttccaactacactacaatactgttcttgtatcgagtaaatgcaacattttaaacaacacgtgtacgagtagttattttttagtattagcactagtagtagtagtgaatgcacaatttccaacaacttgatcttactacaaagtctagcatacaatgtttgaaggttactggttaccattgtgcaacctaaatgataacggtacggtgtttaatgaaagcaacaatgaagagtccgataatgaagcgtacaacaataacgttgatcaaggcattgaacgtgatgccagcacaccaccgttcgtgttgtctacacataaatttcacgaatgctacacgttcaaaccgagcgctcagtacgtgtacgatgtgtgcgatgccatagcggcagagtgttccgtcgagagcaccatcgatgcattcgaaacggacagaggtgacgacgaatggttctgtatagatttcctcaatgaacgcacaacaaacgatcccgtagatcctgcactattgcctcccgactctgacttgaatgcaataggatggtttgtggtagactatcaaaacagacgaatccatacaaacgatcccatcttttatccggtactcgagcacgtctacttggaattttacgctctaaaatacattatatttgtggtactaaaaaatataccacgctttgtagttcacattgtagattaccatgccgacattaaacctgaagtgtcgctatccaataatggcattggttactgcaattctaaaacaacgacaacgacaacagcaacaccaacaccaacaccaacaccaacagcaacagcatcaaccaagattgctaccatagagactagaggcatctctgacatgtttctagtttggatttggaagggatcgtgtgatgaagcttaaagatttggtgtgagtgaatttggaaaccaatttaaaactattgtaaaaataaaagcattatacattttcttaatacatttattaaattttatatatgtatattagtatgttacattacatttgtttattaaataattaattaattaaagttgtacaattgtatcaagttgtatttttttattaatctacatattctacatctacatcatcatcaacatccacactgtcagtgtcctccaacaaaggccgagtatcaccactaccaacaccactagcactacctccaacaccactaccactacctcctcgtccccgtcctttgagcaaatctcccagattgaatttgacgtacacgaatcgaccaatgatgactagcactacagcaaccactgccagcagaatgtatttcaggtacgagcccagtttggtcatgaacgtagagcccagaatgtagtgggccgcatcacctgccgcatcaacgatcgtctctagcagtgtagaattggtgacacacttgaaagtcatattatcgggcagagtgtacgtattgacgtaggcgtacgatttctcatcggcattgggatcgaagccggtgcacggaacctttgccttgtccgcagtctgcaccagatcgcagggattcttcaaaggatgaccctctgacgaatggtagtagtgttccgacactttggcaaacagagtgtcgttctgtacgattgtctcgaacgtttccatggtgggtgtcacaccgcccagtacactggtcaaactctgccgttccatctctgcactgggatcgttgatggtgtgcaaaaggtacaagactggattgtccaaatgatcgtacttgactgcggaaatgtgcttcactcccgtcacggaggtgctgaggcaagatctagtgggtaccttgaacgatgtagtcttgcctcccttgagcaccaccaagtagaagccgttgcgtgcaaccgtagcctctaccagcttttcatagtagggcactccgatggatatggccgcaaatataccgaccgccacaccacccactttgaccgtactccacagattgtcaacgatgccctttagcttggtcctggaggctttcggcaatcgttccaagtctgaggcgctagtcaccacaatgtccaagtcgggatgtatgattcgagcactctttaccgtctcttccatgttgcgtattctaatgtctggggtgtcgatgagcttgcgaaactttagctcatcggccaccgttatggcggtgggtttgttcagcttgctaaacatggacgccagctctcctcggcgcaatagcgattccacagtgtgtagctttacaccgttcacggccagttgccgatcgaccaggctatagttgagtgtgccaaacacatcgtcaaccgaacgtataccggtcttggcgtttcggagcgtactcacggtactggccggtatctcgtctactggctttagagcgcgtctaaagatggatgtaaaactcattgtggcagagtgttgtagagtttggattggttgatagtttgtactttatagtttgcactttataatttactttatagttgatactttatagtttatactttggtttggattaggacaaggtactgggggataagtaaaggatccggattgggtctctaaaaaataagaataccagtgggtttagtttttatatttatttttatttagtattcaatattattaaacattatttttatttagtattcaatattatttaacaatatttttatttagtatttagtatttaatattatagttgtattattatagaactgcaaagacacaagtagtctacaaagatgcaaatatcctacaaagatacaattaacctaaaagttacactagataaaatacaccaagactcactccaacctagacctctttgctgcactaccttcatcgtcctctgtagcatctacatcaagttgcatagcttcatccaagccaccttcatccaagctaccttcgtccaaaccaccttcatctaaaccaccttcatccaaacacaagtccttttctataccctcttcctcagtttcatcaacctcgtccatttctgtaggttcaggattttcttgattttcatcaatatctggattctctaaattctcttgattttcatcaatatctgggttttcttgattctctacaaaattacaatcctcctccatacactcttctttaacatcatactcaacctcctctttaacttcgtccttaactttatcctcaacacactcctcataatttaccttcacctctacaccctcaacatcttcatcctcatctatcgactttacattacaatccgaaaaggacacatccgaatcgttggcctccactttggcattcttaaagtcttcaaacacctcaccctcatccattagattgttcatcaactctttcatggccttttcattgtccatattgagttttgtaagcgggccactacatctgccgataaactctttggtctctgtatagtggcaaaagtcattggacatgggacacttggcattgtacacgtccaccacaaactcggtactggtgccgccaaacacatcgcacaactctttaaacattctccgttcacgattggtggtgattgggaaaatgttgctagtgctgctcttgccacccatgttgctattgctggccggtatggagccgcgctgtggtatcgcacgtttgggcttgatcatgttggccagcactcgttgtggaaactctccgctcacagcgtgcaacggcaacttgatggtagagttggttggattgttgagattgcgattcagtagaaacatgacggccacaaagttgtacattagtatgtactctggtttactgtgatccacgcacagcgaattggtatagtagcaatacaaaaagttggtcagattgtcagtcatctctactgccgagatttgcttcttttgatacagctccagcatgactctacagttggccacaaacactatgcgcgtaacatgaggacatccgttcaactgttccagctgcgatagcacaatctttggtccggccaccttaaagtaaaactctacgatattcttgtacagaatggcatagcctacgcaatccttgactgcggccaacactgcatccacattggccacactgtccaacgacactcggtaccagttgaacgtctttggtgcgtacagccacttgatgcaaatggacggagtcaccggattcatagtgcccttgttgaacatttgcgactctttgacatccttgagccgcttcacgttcagtgcagtctgaatcttttgcgattgaatcatgatgctatagtgtaggccaatgggcgtcttgtcgataccctccatcatgggattctttgaagtgtacaacagatacaattggttcttggtcaaattctttagattgatccagtcctcgtaaaactgatcgtagagtgcaatctcagccttgatcatttccttttccaactctaccgggtctagcttcttgtacaggctgctgtgtacactgctactgcaagtggtactgtctgcggcaaactcatcgtccagcttgcgtttgaccgcctccttttttatattgtactcggctgccctctttagtcgcaaacggttcgcttcacgctcaatgcaaaccttgcgcgtaatcagcttccacacggtgacgaatcgtgcaatgtttagattgtctccagcctcggaatcgactcgattcggtggtcccgtaatgtcagtcaccagtgtcgattcagacttgcccatgctattgatgcacttgagggtgcgtctaaaggtggccatctgacgcttcttggtaaacagactgctatcgtcaccgtcaaaggtaaagtcatactcggaccgatcatagttgcaccacttggagacaaactcttccgaattgatcagtatcagtctgagaataaatcgcaccgaatctggattgtacttgtacacgtccatcagagaggtttcggtaaagtttttcactgcaatcttgtcacccatgtagagatcgcccatcatcagtgtggccggcgacagagcgtgcaacagcgaaaactgagtctgaccctcgcgttccaacactttgctggaatcaatcttgtcgtcaaaggccgacttgagagcctgctcgtcagacgtcctcgtcagattgtacttgtacagttcaatgtgccgggcggtaccctttgacttggagtgcaccacttcgagaatctcatcgtcacactttagatagtccgagcccctcaggcaattgtcgacattcttacagttgaatgccaacaccatttctatgaaatcgtgcacctcattccgcatgatgctacagcccaagtgcatcagagtgtcaatctttgccagcagattgccacggtgcaccttggtgaggattcggtaaaacttggagtgctggttgaaccacttgtcgtgcgtgtagagcaagtgcctaaactgttgacccagcgcatagcgtggcttgtaaaacagattgtgccgatagccatagttccaggacatgctgcgcatctcggtgatggccatcttcattaggttgcgattcatagagttttcatacttgaggtaattgatcgagatgtcgtctccgtcctgatcagcgtgcagaccgtccagtacaaacggattcaagtgaatacagggatcggtgtcgtgatgaaacatttcacacacatagatgcacgtatcgttgatgctcgggtcacggttgataatcaccaaattggtggccagatccaggttgtcgtaaatgtctcgcggaatcgaaattgaattgggtcccagctcattgtccaccaccatcgtcatacgggctccgttgtgtctgtggcccagcaggtaggatcgtacataggaccgtttgcccgattgtagaatgctaaagttgctgcacttgaaatcgttttgcagaaactttttcagagtcctatcaatgtacttgtgaatcaaagtcttgacatcgtcgcacgaaaactcactctcctcggacggcttgacgagcttgatcttgtccggcatgggagtgtccgtctcgtaggcgtgctccatttgaaaactcaactcgatgatggatcggaaaaagctaaagtttttgatcgagtacatcttgggcaggggaaagatgaagcacttgcccagtactcgtacaccaaacgcattgctgtactcgtgcgatgccacacagcactcggcgtccgccttgtctggatcctcgtcctccagaggttcggtcaacgagtctagtgcatccttggtcagagtcactccgtgttcgatgcacattttgcagtcttgcaatccaactggtcgcaccttcttttgatcggtacgcttcagcttgaacaatcgatacagatccttgacgtctacaatcagcgtattgcactcgtcaacgggctctatagagtagatttgcgcagtactccagatgggtttagagttggtggatacaatctccattttagaaagatgattttaaatgcaggataggtacagctgcagtcagagagaaccgtctactttgagaacacaataaagactgtaccggtgacaaatggtgttggccaatttatacacacttgtgcgcatttaataaaacattgcataaactctgcactaggccacgtgcacatttgcacaatgcccgatagtcactctgacagtgatcgacatgatttacttggattttaaagatttacaaaaactacaattgcccgacaatgcgtggaccgaagagttgatcgatcagcgtccctgtttcgtactgcgcaatccagtctattgtcgagtgttttggatgcacctgtggcgggctcgactcgtggactcgttccggaaacagcaaaactttgatcgaatcgaaaacgtggacctggatcggatggtggtcatcgatgccgagactggggctctactctcggcaccggcatcggtcaacagtctagagacgtttgaacggctcctcaaaaaggacacgtactatgcgtccaatgtactcttgaccggtgtgagcactacactcatcacggtggtctatgtgattgtggtgattgtggtggttgcgatcgcttgctacactagcctatcaaagaaaccaccaaagagtcgttggtatgatatgctactcttgttgtaatataaactagcttaaactatgtacttgactttgaatacaacaacaataggctattgtctctattccagcacacacaatagtagatttgggagaaaccgctaatactaatcatggacggtcagacttcgtgcatttccgagtttaacctcgaagagcccagcagtagatttaccctgtttcccatcaggtatcatgacatttgggaaatgtacaaaaaggctcaggcctccttttggacggtcgaagaggtcgatctgtccaaggacctgtacgattgggagactcgtttgactgaaactgagcgagagtttatatcgcacattttggccttctttgccggctccgatggaatcgtcaacgacaatctgttgacgagattctctcaagagttgaccattccagaggtgtcgtgcttttacggattccaaatcatgattgagaacgtgcactcggaaatgtactctacactgattgacatgtacattcgcgatccgcaacgtaaacacatgctctttaacgcaatcgacacggtgccgtctatacgtaaaaaggctcaatgggtgattcggtggatcgatgacgacaagtcttcgtatgccgacagactggtggcattcgccgccgtagagggcatcttcttttcgggtagttttgcggccatcttttggctcaagaagcgcggactcatgcccggactgacgcacagtaacgagtttatatctcgagacgagggcctacactgtgactttgccattctactgtttcgcaactatctgcgtcccgagtgcagatccagcgatgaaaaggtcatcaacattgtaaccgatgccgtgaggatagaacaagagtttctaaccgaatccctaccggtcagcatgattggcatgaactgtaagctaatgtgcgagtacatagagtttgtggcagatcgtctactgtacgagttgattggccgcaagatttacaacgccaagaatccctttgatttcatgaccagcatatcactagagggcaagaccaactttttcgagaagaaggtcagcgagtacaaacgctacggtgtcggtgtcaatttggaggataatgtgtttaagattagtgaggatttttagagagatggtggtagtgttgatggtggtggtagtgttagcggtgttggtagaattatatgtatagagtctacttgactgtatggatttggttgtatagaattgtataaaattatatagaactgtaatttagtatagtttagttttttagagtttagttttttagacgagttttagtacaagcttcaatacaagttttagtacaagttttagcatagcatactctgtatttttttcatacaataaatattcatatgtttaaaaaataaaacttttgttttttaatcaaacatttatttatacatattttttacactcctacatttaaaagtatagcaacttgcaagtaatatcaaaactcctacagttaaaattatagcaacgcacaacattattcaaacatgtacaagtaaaatcaaaactcctaaagttaacattatagcaacgcacaacattattcaaacaagtacaagtaatatcaaagctcctacattcaacattatagcaaatcacacatctaacacaagtcaacgttagagtcaaggctcctactaaaggattcgacatcgtttcggatgctttcaatttgactcttaaactctgcactacattctatcgtcttgttgaacgagtccaaatcgagcactcctcccgacactcgtacaatctctcgagccaatttcagagcacgatcaatgtagtctacgatgcgttcaatgtcacactctttgacaccacgggtcgtcaccgcaggagtaccgagtctgatgccgcttggtctgagagcgctcttgtctccgggcactgtgtttttgttgcaagcgattctgcacagttcgaggattcgctctgccggtgctcctgcgagtcccacactgcgcaaatccactagaatcagatgcacatcggtaccgccagtggtgacggtgtagcctcgtgaaacgagtccctctgccaacaactgtgcatttcgcaccactcgtctttggtagagtgcaaactctagagtggtggcctggtgcattgcggtggcgatcgctgcaatcgtgtgattgtgcggtccaccttgcaggcccggaaacacggctcgttcaatttcctgctctagtgatttgcggtaaaagatgactccggctcgaggacctctgagagtcttgtgcgttgtagtggtcacaatgtcacaatactcaaaggggccaggaatgactttgcccgcaatcaagcccgcaatgtgtgcaatatcggccatcagcagggagccggctgcatcggcaatctctcggaatcgtctatagtccaagcgccgaggatagcaactggtgccggctatgattagcctaggtttgaatagattggcactctcggcaagtttggcatagtcgacgagtccagtctgaggatccaccttgtacggcatgctttcgaaaaagagcgatgtagcggacacgttgcggaatccgtgcgtcaggtggcctccgtcgggcagatcgagtcccatgattctaccgtgcggtttaacgattccagtgtacacggcaaagttggccatcgagcccgagtacggttgtacacacactccccactcggactcgttcaaattgaacgctctgagacatcgctgctgtgctagcagttcgatgcgatcgataaactcgttaccgccatagtatcgctttccgggcctaccctccgagtacttgttgatgagacacgaactcatgcattctcgcaccggtagagtggtaaagttttccgatgcgatcaactctaagcctgcccgttgccgatcggcctcttgctctacgagcgcatacagctcgggatcggtttcgtagagattcattactggtattgtttggagtaacgagtctacttgaagagtccctttaacgagtctatttgacgaatctatttgacgagtctaaaaaactagaacttgaaagacaaactctgagagcaacttgacgagtccctttaacgagtctaaaaaactagaacatgaaagacaaactcggacaataacgattccatttaacgagtctaaaaaactagaacatgaaagacaaactcgggcaacaacgattccatttaacgagtctaaaaaactaaaactaccaagtcaaaggtgcactctaacgattccatttaccgagtctaaaaaactagaattgtaaagtcaaactctagcatcaaagagtcctccaagtaacgagtctaaaaaactagaatcataaagtcaaactcgggcattaacgattcactataacgagtctaaaaaactcaaactctaaagacaaacaccatcatcaaggagtcacactgccgagtccaactaccgagtccaaacaacgagtccaaataccgagtccaaacaacgagtctaaaaaactagaattatcaagtcaaactctaccatcaaagagtcacactgtcgagtccaaataccgagtccaaataccgagtctaaaaaactcaaactccaaagacaaactctgtcactaacgattccaaacaacgagtctaaaaaactcaaactcaacagccaaactctacctccacctctaagagacgattccaaacaacgagtctaaaaaactcaaaatcaaaagccaaactccacctctatcatcaaagagctaaaatgcacaatttcaaacaaaacttgcacaaaagagtcccgagtccatgcataaccttgagagactcggtctaaaaaactagaacgatttgcatagaaaacgccttttcaaccttttcaaagctgaaacattttgctcgtttctaagagagtcgacaccgatataacaccaatagcgtattagtgttaatattgagcggatttgttcacttttcgcattctgactttagttgtgcgcaagtttgcacgccatagtgtaaatacggtattgtggtaaactagacgtcgactttagcagtcttgcaataaatcatggccggtgttcgttcactttttactgtgccctccaactgcactacggaccttgctcgcagtggtgtgagcaaatccttcaacatcctcatcgagggcaatattgcttgtggcaaatcggccctcttgaatcactttaaaaacttggactcgttcaccgccatagaggagccgttgcatcaatggacaaactttaaagggtataacctgttgcacggcatgggactcgatccagtcaaatggtttgcggcctttcaaacgtatatatgcactacaatgtttgaggctcacactcgaccggtgcggactcctttcaagattatggagcgctccttgctcagtgttcaaaattgctttatagatgcctttgcatcatcgatcatggccaagagtgatcccaccgatgcagactcgatggcactcttgaatgcggatgtgctcaagagtctgtgtgaagtgttgatagacagtgtgcggatcgatctcattgtgtacatgcgcaccgatccctcggttgcaatggagcgcacgattcgccgaggtcgcatggaagagtcccacatagagttgccctacttggagaagttgcacgagttgcacgaagactggctcattcatggtaagaaaccgatcccggcaccagtgttggttgtggatgcaaactcggaatccatcaagggtacgattcgcatcattgaaggctttgtcaagagctatagctcgcaagagtacgccaaggacactgcccaagagtatgccaggtttgctagggatgctagagatgtgtatgccaagatttgtagcgaggatagggaatttgtgtgatttgcaagtgtactctaaaaattgcaatctatacatttaaccgtgtgctttgtcccaacatgtattacaagtcttaataaagaatatttacaccaataatcgtctattttttttgattatgtaggcgagcgtcctttgttagtctcttttcctctctctctcttgcatctttatacatttgcatctttagctctatacatttacaagtatgaagggtgtcaacattttagcactggcactcttttggtatggtgcgggtgcatttgataaatacaatacactacccgatcgtagaaactacgactttagctacctctctgactttagagttaatcctaaacatgcaccaaccatgcgtctagagaatgaacgctatgacaatctatacgatgacaactcgttcaatacaagagttaacgtcaacaagcgcattcatgctacagttagacctgttcgtaaacacttacctacattacccagacttgctcctacatccaatccaacctatgctgatcatgaatctgatcttgctgaaattcacgcatacaatagacagaatccattcaatgcggtagatcaagatcagtttcagattcccgatgagtacattgacgaataccaacaaccacaacagcaacaacaggctcggcaaatgaatccgttcgatagggttgatgaaatacccgagtcgaatgaagattccgagatggatgccatgtctagattcaatccaatgaacccgttcaatgtggccgattccgacaatgagcaacctgagagtattcgcaaacgatacaacaccaaagacgagtccaaattcattacgcccgaggaattggagaaactcaaattcttgggctatctgcaagactttatggtaggtgcgcatcttaggttgaccgatggtaaactgtcactagaggagcctgccatgcaaccggtagtcggtgcactagaacgattccaatcgtacgcaaacataccaatcaccggtgacatggatccgcacaccaagacaaagatgaacaccaaacggtgtgcgatgccagacatttcacccaagcgcgcaaaacgatacacactccacgacacatggaagaatccgataacttggagtgttttggccaactcttcgaatattgaaaatataaacgttatccgtaccgatgttgacagaatgctcaaacggtggaagcgagaggctccctccttggagtttgtagaggttgcccccggttccaattctaccattacactgggcttttatcatggcgatcacggagacggtacacgattcgatggcaacggatggttcttggcacacgccttctatccgggacccggcagaggtggtcagattcacattgacgccgaagagccatgggtcttttcgaataacgctgaggagcgcaaacccgaggattcggccgacttccaatcgatagcgttgcacgaactcggtcatgcattgggtgtgggtcacagtgatgttcacgatgccgtaatgtatccatactatggtggtgtcaagcgtgaactcaaagaggatgacattgcggcaatcaaagccttgtacggcaacagaaatggtacgcacaccaatcccagtgacaaacgagaaaaggaatcgtacaaagaggctgctgcagcaccggtaacagaaccgacaccagtgacaagaccaccaccgacacaagtaacaacaccaccgccacagcgacccaagacggaaacgtacaaatccaaacttggcaatccctacatttgtgatttgcccaagtatgacagtgtggccaacatgtttggtgaagtgtacgtgttcaagggaccgtttgtttggcgtatgggctcgtttaatcccaagactatatcagtctatccaatcaacaaagtgtaccatttgccagactttgaaaagctagacgccatctacattcgcaaagatggtaaagtggccatgttcatcaatgatctaatgtacgtcttttcgggcaatgatgttgcacaagggtatccaaagaagctttccgatatgggcatcgaaggctcaaagattgacactgcctttagatggcacaacaagacgttcatactgagtggtgacaaatactggttgtttgatgaaaagaaggacaggattgcaacaaagacctacctcattgccaactatttccgcaacctacagacaccggtcgatgccgccatgtcctggctgaacggtaaagtgtacttcttcaaagacaggggcttttacgagtttgatgaatacaaaatgtcggtaaagaatgccgacccgtacgactctagcgtgttctgggccaactgtcctagagaccatccgcacatttgccagatgcaacacatgtacggacacttgacggcctcagactacaacacttcgatgaacgcagccatggccgatggagcgtttgactactcgttgctgcgcatgattgacactgtcgacacgtttagatacactgtgattccagacaatgcaactcagccggaacgagcgtcgtacaagagactcgccaacggtcaagtggtggtggatgttgtaccagcgggcgagtgaggatgatgagattaaagtagaccaagattgcaagattataagattataagactagaataagattttatgtagactgaatgtaatgtaaaatactcttaattaaaatgttttacaaaatactctaatactcagtgtgtataccaaagttgaataatgttgtagattataagatgttgttatagacttttgtattgtaccttgtagagtaggtaccttgtaccttgtacttttgtattgtaccttgtagtgtaccgtgttttgtaaaagtttattaaataaagttttgttttttagtcaatgaatgattctagttttttagacactatacctttaaatgcaaagagaatgcatccattaactctacacatttctacatacacatttctttagactacaatacttttaaaatgtacacacatacatacagagagttggctttaagcacctgcctctagtatactccaactattctaaacgcctgctactagtctttagcaacaaatgtcaatttccatacaatgcatgtacaaaacacaaaggttcaaacaaaggcccaatgtttaggaatgctcattgtcaaagtcaaagacactacactgagactgtttgaaatgcacggttgactgaatagtgctcgggttgactgaatggtactcgggttgactgaatggtactcgtgtgtcgagacttgatacctctgaggaccatcttacaaggggttactagttttagttttttaaacaacatgtaaatgatttgatgaaaaaaattaaagcatttacaactctgtgttttagtgtttgtaacttagcataccagtacttatgaatcggacaactctgtgttttaattcttgtaactttagcataccaagtggacttgaaccatctctctacctaaactattactaaaatacttgaccatctctctctacccaaccaaacctacttgaatagtacaagtctataaaaaatcaaacaatttaaataccaaaaaaagaagcctttatttattcaacaatgatacatggtcaacttaatactacaacttaatcctacaatttagacactggtttacaatactcttaattctaaacatcaacactctacactctacattctacacaccatcactctacaccaccacctctgaaccctccttctcagcttttgcatccatggcttcagacacctccttgaacagagtgttgaacggtcccaccttgactaggcgtactgcgtccattagacggtcaagaaaggggcgcttcttttgtgcttcaaagttggcctgcaagttgtcaaacactgcattgagcagcttgctctcatccacctccttgacgtgatcgtactcggtagagctcatgaggtacgttagaatgttgcaaatcttttggttgacaaacaagtggttggatgatgaaaattggccatctgtacgctcggcgacagcctcctttgttgggtacattttctcgtgtagagcatcaatgtaggcaacgtcacccgggtacttggactcgttgcttgaaaacactgcatacaatttggtcagcatgtcttcatagctcactggatcgtcacactctgtgaatatagagtcgtgcaagttggccacaaactcttcggccagattctcatcggtcaccgcctccattacagtgtcgatggctttgatccacttttgatgcgactctaaaccttccatttcatcgttcataatgtttagaatgtgagccggcggaatggcaacatctatgggatcgccaatgcacatttgaacaccacgagtgccgcgttcagttacacgttcactgatggtgtcgtcctcttcaagggtcggaatctctatacgctcacaaatcagttgtgcgatgcgatcaccctttgacactacaaagtcgtcatcggaatggttaaagaggaccactccaatgtttccagtatagtcgcggtccacgacaccggctccgacgtcgattccgtacttggctgccagtttggatcgcggagcaatcctaccgtagcacccttccgggatcagtacgccgaggtcggtgttgacgagcaccctcgaccgtttaggaatgacgacctcgtgagcgctgcacagatcgaatccggcagactcttcggtagagtggatcggcatcttggcgttcttgctcagtttacggtacttgaggactggggcagacattttaatgatttggattcagagcagacaagatgaagctaagagagctggatcacttgtgcaattgttctactaatgttgccccatttataccaccaatacagtattatcaataaatgtgtcatatagttgcgtaattaattacattttaattgaatgattaatgttgatcaatttaattaaatgacaatttccggtgtgtgttcttgattagttgttctcagagttccacaacattataccatttcaatttgagatgaactcaaccatgcactgcactcagccatgcactgaaccaccaaatctcctagactcattgattttcaatattgattttcaatatagagccaatcaaagagtttacgagtccatttcattaacctgacccgattccatcaaagtgtagccataaacgattcactctagagtaaataggatttcaaacaaatggagacattaaccacgactctatgttttgaactcggaagagtaccagtactaacaagggttaaaaataagagtagatgtttgattaaaaaacaaagagtagatggttgattaaaaaacaagaagaatcttttgatgaaaaaaatagaatcattacactctttattcaacatttatatttatacatatataactctactctataaactctactctataaactctgatgaatacaaaacaaacatatagaactctaaataatcgtaaatgtaaaatctaaacacaaggctaaacacaaggctaaacataaacctaattaccaacatcaacagcaaacatcctacaacaatatagacatgctatcatccgagtccaactgaaggctactgccactgctgctactgaccggttcaaactcatcgttgctcgtcttggcaatctttgatggtgacacttcattctcgatggcttcaaagtctatgggctcttcgagggctggatccgagtcctccacagacggatcatcttgttgtatgggcttgaatccaaacaggctaggttgcaccattgccttgtctggtctgatcaacgagtctttgaattgaaacagtacaaagtttcgtatgcgtttaggtttgacgagtgcacgctccctggccctgactcgttccaacagactgatggactggtcagattcagactcggaacggtcaaatgaaaactcttccgagtacgattctatggtgctagatttgatcgtgtaatctgtactggtcgatgtgacagattcagattccgagtctagggttgatttggaggaggcttctttcgagtttgatttagaggcttcgttagagcaattagacggctctatactctcatcctttgaagtggctttatcctcagagttggactcagagttggactcagaagtgcactcggatttatcctcagaggattctttaatttccgagtgattcgactcttttgatggaatgtgttttgactcgtctttgttggaatctttgtgttctttagactctttatgctctctacctgttgatgtattcgaatctactctatcacagccaatagaatctactttagaatctactctagaatctaccttagactccccctttgagcatcctttataatctctcttcgagtcccctctaacctcggacatttgcaattgcaactgtttacctctctgcacctcgtcaacttgcatctcgcagccttcacgccaagacgtcaaatcgcccattccgaaactcttggctcccttcattagacgccactgtgatgtgggctctataaactcaaagcactgttcattgttcgagtatcgatccacacggttgccgtgttcgtagtagcgcgaacaccaggccaacgattccacccaacgttctacggtgcagttttctgcccaagtcaacttgggattgtccttgttggcggtgcgcttgtccatcaccttggagccaaagtgaatgcgtatcgagtgctgattcttggcatgaaagattaccttgcacacttcgtacagtacggtacgccagtgtttggcctttgacagggaatcgttggttatgctatcaaaggcgttcaacagtgtggcatcctgatgcctcatcacgtagcactgacaaatggccgaaaccatggacggtgttagcaacggttgagtgtaatcggtacccatcattataacgattgccgaaaacacattcctaggcataccgcacacgttaaacttttgcagattcacaaatcgttcacctccattgagcaacaggtacaggggagcctcatcgtcgtaccgaccgtatgcaatgtggtaaacgtcactgtcgttggtcacgagtatggtgggcttggtgggatcgcgatccagtatcatttgcatttcgctttcgcccacctccaactgtaccactcggaaccacgactcttcctcgagcatggccttgtagtactgaagcgctgcctgtgcgttaaactttagatttacggcacgcttctttgaagtgtcatgtttgcgtgtaggaggcaagccatcgaagtagattacaatttccgaaatctttacactcaatcggtacatcattgctttgagtagatccaacgcattgttggctatagtgtgtgcatctacgcatccgttgatgacacccttgaagagggtcaaattgccatccacatgtacagtatactctaggctgggatcgggtgtgtcgtacgagtcgacaatgtactgcttgaaaacgttgttaaactttaggatacccatgatggttggtgggctctgtcagcctgtatactagataccaaaaagtaattggatttctacatctatacactagtttataagccagatagggtaaacactttatccactacacccacatacataatgttgcccatttcatccatggaatacaaaccgaatgggtgaatctcaatcttgtagaatttcatacgatgaaaggttgcaatgtaggaatcgatgcatcgttccgtgtccaccagatgcacagtctcgaccagattggacacactgggtgcactgggtgcactggggtgcggtataccactgcgtctgagcagaatcgtatagggcactcctcgatcaatgtgtatccatttgcgtgcatttagacgcacacaggatcttgtcatttcgtagacgcaatcgaaacacttgtccgatagcgtagaaaagaacgtggacaggtagcgagtggcatcgggtctagtctgagacatgccctccaggacagtgctaaagttgctactctcaccggccgagtgctgaaacactgccagattggcatcgtcgtcggcgttgtgcatcatgcacgtatagtgattgatgcagcgctctgtaaacttttccacttgcataggcaccccagtcaggttgacgctcatcagactgttgtagggatcgtttttggaattgctgattgccggtaccttggacatgagcaccagattaaagccgggattcgagacggtcaccgattcggcccaaactatggagcacggaaacgcattcggcggacaccgagtgtacgtgcccagattgagtttggagcgaatcgttgtgggtctgagggtcagtagcgatttcgagtgctggtacagcgtgtcggcaatctgtcgcaattcatgcatttcattgtggtagtgatccaactgtacggcagcatagtatctaaacgtttgcacagtctcgtcctcgagcagctcttcatcgtacgaccaagagatgcggtccgcgtcgaccactagatgatcctcaatgtcgtcgattatgagcggctgttcaatgtgtagaatgttgatgcgcaaatgctgcaaatcactgtccacaatcaccagatcgtgatccagagacgcgtacgtggatcgaatcgtgtacgggtactctaccatgagtatgcacggtttgtgcagaggttgtagagtgcccgcatcttgtacgtgttgattgtgtgtaaattggacagtgccagcactggtagcttccagagtactagaatcggcacttttaaaactaccattgcttttagcgctcttgacaatgttggcacttttaacattgtcatcaacagtactctttgagcttccgagcatggcctttttagtgtacagtttgatggcctctgcaacggtactgggctctgtcatttcagagttggtaatgggtttggtattgcgatagagttccgagatgaagctaccgttcattttgatgccaaactagtacccaaatcctactactactagtaatcctactactaatactactactggtaatcctactattagtaaattaaaataaaactcttgaaaaatcctacactaaaaagatacaacctcctccctcccactcaacgcctcttgcaaccgcagcccaactcttgctcgttttcgtttaccggtacactgcctcttactcttgtgtccgattccgaagagtccgagtctacactgtactcgctgtcggtatcggtgctttcgattctcttcttaccgtcgctctcaatgtttttgtaatagtctagaatgattgacaaatcgtcctcttgatgatcgtaagccaacagtctaaaagtcaaaagttgcaatagctcaatgtttgaatcaccaataaactgattgaaatcggtgtgcgcaaactcatcaatcagattgtgtcgcatcatgcatcggtagacgaccctcaacattgcaatactgcacaatagcaatcgtaaactttatcgcatacaaggcacacgcacaatagcctatgcaagatagagacacgttgaaaaactgaaattaccgtacaggtagtgtaaacatagtcacaataggctattggtgttatcaaacttgtgcattgttatagtatgacgatggtttcggtcggttctaatacgggagtctttgtagttttgttgactgttttaaaggccatttgtgattcgtttattgtcatattcttgtacttttcaaatactagttctagtaattgtcccactgtaaactgtgactcgaccactggtactctggcagctagataggtaggcagtgctcttgtttttgggaatcatgtttgcaaacattcaactgaaccagcaacagaattgcgtagtgattgacaacgtaccgtacgaggtcaatggcgacttggagtttctctacaatggagagccctacgtcgtctacctcaacactctgcctctgcgcaaacacaacaactttcaagtgtccgatgtgtacacggaaacgttttcaatcatgcgcaagagtatggccctggagctggctcagtgttttgccaacctggtgcccatcgtcaacattggcctaccggtgaccaagacgtgcaaggctgccctagaggacattatgaaccacttgaacgcaatggtcaattccaacaacgatcccaacaatgccatcgatcaaaactcgtacgcgcaaatacaatcgctaatgaagacggtcgccggactcatgaacaaactgaccaactctcagctcgtaacctacctgacgtatggcaacgtgcagagtttgcgtatgacggatgagtacagcaacatttcacagaaactcaccgccatccgacagtacattgtgtgtgccatcacgttcaagccagagtttgtcaatcatcgcagtctgagtctaatgtttgacgtgttcctaaacattgtgggcactctgtgtctgctgcactcgcacacctttgtcgagtaccgcaatgtgcaggatttgataatacacgaaatcggcatcgccatcgagagtctcatctacgaccgatgctccaaggtgctgttcattgacggtgccaatcaggtggccagcggcatgtacaacgatctcaagattaaatatcccgaactgaagagcatcaattctgaaaacgatttggccaaaatcaaacacttggaggcggcattcaacgaggagaacgccaagtacaatgtcaacctgtttccgtacatgctcttttacaacatgtccgatgcggtcaggatccgtcagaatcttagatgcatccatgagatgcgtaaaaatgtagcaaacgatgttgagcaatttgaaaagtttcatcagtttgtcgtcgagtgttataataatctgattgagcccctaaacggcaagcactatgcaacctacacctttgactctatgcaaaagattttcacacatgccatctttgagcaagtcaatccgggtagtctaatgtagtttgtaagacattcatgtactcttgaataatgtaaattttaggtttttctttttttaaccacacctctaatacgctattggagttggctctttaacattcaatgatttcatgttcctacagtggtattgttgtgcaatagatgatgcgcactcacaaaactccatcgggcgtctttaaggttgaaatcatgaaagtggactcgttggacaccgacactgaaactgagagcacaatgagcaccaccagtacagaaactctgaaatcaaagcccgcagatgccccggtcgcaaaggactcggactctgaatcggatccatcctacgagtccgatgatggtactctgaccgatggctcggatgcgtcctctgtgattgatgtcaaacccaaagaggatccgagtccaccgaggcgatggtggagacggggagtcacccagatcgaaatggagcccgtccgcaataatagtacaacgattccgatcgacgagtccgccagtagtctgtgctcaccgaaatcgcccgagtgcatggctctgcgcaaagtgtacgcaaagattctgattgtggtatttggctcgatcacaatcatggcactcgcaacgattcggtccttccaaacctcggatatgggcgacgatgtactcattcaaaacgttaccgatctcataaaggagagtatcaaaaatggtgtttgaaaaaactagcatcgaaaagtgcgttattgtactagattagacggtagtataaatacaataacttatggcggttaattttatttgcagtttaacagttgagcaggtcactttgctgtgatataagcatggcttcgtccgcgtcctctcacatgtcctttaatatcatcgagtatgggactcctcaaatcaagatggatttacctcgtttgaagaatccccgtacctcggccgagaacccctacggtaccgagccgcataagccgtttttcgattaccaagagctgatggctcgaaaggttgccgaggtgggtgtcgatacggatgtcgaactcgccgacaccgacaacaccgatatcgagaggcagcgcaatcgtgccaagcgagcctctttggaatcggacagcgatgccgactcggactattcgggcatcaaagtggacggggatcaactcttgcgcaaggccgcaaagtgtgtcaccgaacacaatcgtaaacgtggcatcctggacgccaccgactccgagtccgaggccaagcgtaggcgtcaagttgacgatgagatggaaaactttaaattcttgaacgagcacgttttcaacaagcttgacaacatcaccaagaaggctcaggcggagagtagtcaggaggagccctctgttccggttaggcgcagtcgtccgcagactccgcaccacaagagaaaacccaaggtgcagagtaggcgtgacgattctcaggatgccagcgatgaagacgacgagtgcaacaatcgtgagttgtctagaaatagttttaaccgtagtgtgaatagtggtagaggtagtggaggcaaaggtagtagagctagcgaggccaatagtagatctagtagtagggctagtagcagagccaatagtagatctagtagcagggctagtagccgaggtaatagatcggacgatgaggctgaggaggaggacgatgaggttaacaatgagggcaatggggagaatgccaatactgaggttaatgctaacgagtccaatgtttcggccaatgttgatggttctaatgttgatggttctaatgtagatgattctaatgtaaatgatgccgattacgagtccaatactattgttgaaaatgttggtgtagagggtgatttcaacaaggagaatcttgctccttccggtaaagagtccaacattgaaacggtagcattgggctcggccaagtccaatattgatgtgtacaattttgatgaggacgacaatgccagtgtcaagagtggtactagtgcatctcagagtaggaaatcaaagaccaagtccactattactgtaggtaagaatctcgatgatcggcttaaatcgttgcagttgaatttggagttgaccgatgccaataaggggaattctaccaaagggggctctttgttgaatgcaaatggcagtgctaaaaactcggttaagaatggtagtgctaaagggggctctgtaaaaggaggctcggtaaactctaaagtcaacaactccaactctaaaagtgcatccaaatctaaagctaacaactcgtcatctgaaaagaccattaaatcaaaggctgtaaaacctacacctactcctgtacctagtcctaccaaagaatcgacatctactaaaacacctactcctactaaaacacctactactgctaccaaaactcttgcatcaaactcccaatccaacaatcaaaactcccaatcttcacaatccaacgagtccacctccaacgattcctcatccaacaactcgtcatccaattctcaatcaacagtagtaaatgtaaacgctcaatcaaaagacaatactcaatcaaacaacaatactcaatccaatgttcaatctaatattcaagttaatgatcaatctaatactcagtctaatgatcaaattgatactcaatctaacacgcagcctaatacgcaatcctcaaccgctcctaccaaacgtcccactctaatcaatcacgccaacaccaaagtctctgatcgtatgcatgaactcaaactcaaaatgaatccacccagacgcactgacgaggctacaatcttggccattgaacgtgccgctttgacttgcaaacagtgcaacaaaacctacaagactgcacgcaatctgtcaaagcacacgtgcaagcctaaaaagagtgcagcccccaaacgtggcaagaagcgtacaagttccgaatctagtgcatgctctgagccagagaacaagtctgaggcacccgaaaagaaaaggaagctgccgagtacaccgctgggtgtgccagtaccgttgactagtaacagtgccgacaagcaggccttgtacgatgagtttaaagtggtagagccgggttttaagcatatgcacaagttgaacgccatcgatacgcacaagcatccgatagagttgcacgaaacgtatgcttgtaaggttagcgaacttgcctatgcacagtatcacaatgagacgaattgcaccgctgccgagtttaagcgtgaaacggcaaacgtgcgtcagagcctatccaaacagattgccagtattcaaaatcagctaaaagacaagtctatggacaaggagcttagcggcaagctaaagttgcgcataaagtttctgcgcgcatacaaacaaatgaagctggccgagtactcttacacgtgtcccaagttgaaaatgtttagcaaaaagatggagcgcatctttactggcaatcgtgtagactcgaagggttctctacccaacaagattaccaatgccgatgtgcagaatgcaatctcgtcaattggcaagatgcaagttgacgatggcgatttgacgtgcatagctagatccttggagaattacattaccctcatcacactgtctgtgttggccacgatggtcaacaagagatcgtgccgagtcaccagagccaatatagcttcggtgctcgcactgcagtatgcaatgaaccacgacaaagagtcgtatccgatgccagagcacggtaccatcaagactccatccgatggtaaactgaatgtaatcatttgtcgcaatgtattggatttgaacaatattacatcggtggaccaagtgatggatgtcttgatggacgagtttaatggggagttgaaaaacttgtgggtaaagtttctattctactttaagcccagcagtgactatttcaaagtcatcaaagagttttacatcaagtacataatggcatcgtatatggctctgtgtaagatggaggaaaagagggcctctggtaagcccagcaactttagacagtgcatggccattgtgattaacaattgtacatggttccccttcaaggactatgccaatcataccgatgtgaatctggaccgacaggccgatgacttgtttgagcagtgcgatgtaaagcgcagcactagcagtgccggtacgaaacgcaaagcaaacagagccaccaaagaggtgcccactaagaggcaacgttgcgatagcagcgacaacgagtctgttgccagtaggtcaccgagtccggtaaagagtgcaccggtacagagttctctggccaacaaggctatggccaacaaggctatggtaagtacacctatggcaagtacgcctctggcaaacaagcccactacaccggctgtcaccaaaccaaagagagacgacatgatcgagggtggatactttccgatgagtcgagtcgttaaaattagaaggctcgaacagagacgtatggaggctaatgcggcaaatagaggtaaccttaactctaacactaaccctactccctctaacaatatcgagtccaatactaacaatactaacagtactaacaataccaacacccctaacactaacactaacaatgctaacagtactaacaccactaaccctactaacaacactcccaacccttctaacagtactcccaaaaagcgtacaagtaatggttcacgcaaatctagtgcatcgtcaaagattgaccctagcaggataaagtctcgagagttgattgagaatgatgattttagcagtgatgagaattagagttggtctttgatttggaattttgattcatacttggatgtaatttaaatcttgtagttgattttgtatttagacctgtattcaatcttgtattcaatcttgcatttaaccctgtattcaatcttgtatttagtcttgtatttaatcatgtatccctagagtataagttggtataagtttcaatgtatccttagaatatacatttcaatatatctttagaataaagtcaatgtaacctcctagagtataagtttccatgtatccttagaatatatttcaatgtatccctagagtataagcttcaatttatccttagaatataagttgtattattaaatataaaatgattaaaaataaataaaggtatattaaaaaatactctatatttttaaaatgtgtacagtgtaatattatagcatctagtatacaagtgtagtacaccaagtgtagtacaccaagtgtggtataccaagtctgtgatatataccaatgaatattaatcaaaccattgtatatactagcattaagtattctttttttagacactctacttggacatgtatacttaacactaacctaaattattacttgcattttaccacttgtatgtataacttacaatctacagacatacaatctaccaactagtacaaattatgactttaaatctaagactgagttgaaactctaaataaatgatgaaacctccaagatggactctttgatttaaaccttatccttgttgcataggtacagtgaaccctaaatctaaatataatccctgaatcttaaagctactcttaaacacacaacttggcgcctacctttaaatgcatagttgtatgcacacgtgtacaatgtatgaaagaaaccaaaaggcacaaacctttgttgtctacacagagtacaacagtttaaacttggcacagattgtaaaccgtttacaggccaacgaactcgtgtatgtgtaatggaggttgtgatcttgaacttgaaccgagttgtaaatggagcatagagtttgcgcagtagagttttcatagagtaggtttgcgccttgtgtagatggtgttagtagtatactgtagtattatacttgatttgatattttttaaataatacaaaaaacaatacttttataaatactttaataaatattataataaaaaataatacttaataaatattataataaaaacaatacttaataaacaacatctacataacatacaataccttttactaacatgcaatacatttgatacaacctggtctatgagtattctttgaaacttcaaactacatttacatttacatttacatttaggtacacttacaattacatttacaattacatcaacaactacatctaaaactccttttcaaaatccaaagccacactatccaacacttcaacatctgaatctgtgaggtctgaatcggttcctcctacacaaaccctatcaacgcctactgatatgtttgatgcaacgcactcggtagacacttgttgcaactcctcaagcttgcaacgtttactctctggctgagaatctgaatctgaactagaggccgagtcgaacattacaaactctgccgacttgaaattggcaccagtaccgtactcttcaggttgcgctgtagatgccgagtgttggtctggttcaggttctactgttgacgccaactctcgttccaattccaaatccattttattgacaatacctttaccgctaaccttcctcttggagccagcctttaaaggctccttctgagttgtactctttacgtattgtaaaatgcactcgttgccttcgtcgtcgtagcacaccacctcgtcgggatcagtcttggccttttcatccaaccgatcctgaggctcctctttgaacgtgcacggacactgtatagtgtcgtgcagctctcggcggctcttgctagtgaggccattaaagttgacactgtccttgatgtgtttgtagcaatctagcaacggtgaagtgtttgtctgcaaagagtctacatactccttgtacgtggttctgagcactcgtacgcatcggccctttgatacgcgaaaagcttcaggcgtcaccactggaaacgttaccgtcttgtacagataggccagcacagagtttaccgaaatgattctctgattcaaatcatccgtggtgattttgtacttttcacacagattgggcacttcgggtaccttgtagtagtactcgtcgtttttgacgtgcgtgtacaccaaactgcacaagtcgttggtgtgcaatcgcttcagtcggaagccctctcggatacgagtcaggcccacgtagactgcattcatggtggtgtcgtccaagtccagttccatgtcacacttgtccagagtcaatccctgagcgctatagtaggtgttggtaaagaatcgcaacgggtactggtagcgagcaccctgcgacgttagccacactcgtaaatcatcaatggtattgtaggcgtttactgcgatgcgttgcaagtgctccaaacgaccgctagagtttaccacctcaatgagtgtaggcgacactttacgcacaaactgtaccacatcctcacacttggaagtctcgctgtacttgatgtacgagtagccctgtatgagtacgagcagcggtgcaaacttgtagttttgaggcaacgctaccgcttcaaaggagcctcccgctttacgtctacagtactcggcctttactatggtgcgaccctctttgacgctctccttgaaacatctatgtatccgatccttcatcttgcgatgagtggccgtcagaaacatggccgtctggcactcgttaatgtgaaagtgtctatacagcaaagagtagagtgtatacttttcatggaaatccatgcgtatattgtcgtgcttctcgtccaagtgcaactctatggtttgtataattttcaagtagtcggcatcggtgatgcgcatctgtttggttagcatcagatcgaacgaggccagctccttgagcagatgcatattgttcattttatgatagaccgaggtgcggatggccttttgttgattggcatcgcccaccatcaaaatgttgagtttatactgcctactgagcatgtgcaggaatataatcattagcggttgcatgaccgtgtactcgtcaaacacaatgaggtacggtatcgcgaaatcgccatcgttgcacggcaccatcttgaatgtcttgagcaatttgagtagatcgtaaaatatggaacagatcgtctttgactggggtgcgttaaagatgcacttggcctggttgtacgagagtcccagagtgtgcataataaaattgcacgtggtgcgagcattaatgtttgtgtgcagagtggccgcatcgtctttgagcgcattgctataaactacaaacatgatgggtgtgagcaacgaacacgccatgacacccataattgtggatttacccgtgcccgatctagagtttagtacaccgaaaaaggagtcttctatcgagtgaatcttgggcggcgtatacttgccgtctagactctctggtacgcaggatgccgtgtccaatctaaagctatcgctaatctgtttgtgtataatctgaaaggccaccttttgactagagtttagacagtggtacgcggcattggtctttcggaggcatgcaatcgacatggagggagtcgcgttctcgtacggcggatagtcttcaaagaaggcgatcggtttgtttagaatgaatcctagaacgctgtctggcaaatcgttgactccgtttgtaatcatgcgacatccctttacgttacgctgaccgttgacgatgcacagtttggccacttgtacaaaattggccctattgatgcgcgtgtcgggagtgttgattagagcctttaattgatctacatcgtcttgtgtaatgtcacgtttacgcaccgagtgcagtaaacgtacaatttcgataacgcgctgagaccggcttagtgacgcattcatggctgtataccactagtgtatataaatatcgaagtatttaaaatttcatttagtacaatacggtattgcaactataacggtattgtctaacgtagaattgtagcatcaagtaaactagtactaccaactttgtattcatcatgatgaagacaaacattgaatctgcactcaaggctcctcagaagaggccagccagtgccatgatgggcaacaacgtgatgcccagtgcgagatctgtagatttgcaaagtgtcatgggagactcggccaaggttgatgagagcctctgggactcgtcgaatgcggtccctgcggcctctgccgaaactgtagattttgccaaaaacattaaactcatcgagccaccgccgcacgtgaagcgcatacccaagtttgtgcaattggaagatttcaaaaaggccctggtagagtttatcaaggaggagggctcgtttgaattgaacgatcccaatcacgagactctgcatcagttggatgtggagcatttgtttaccgacgagggcaaaaaggccaccaaggtactgtaccatgccgtagagtatgtctacaagaatctgtacgaagacttgattacaaatacgggtgatttaaagtttatcgaatggtgtctgcactttttatcaatctacacggcagacgccattctcaagctaaaagagtttataacgattgcgaccagcagctgtggggactcggtacgcgtagacattaagcgtccctgcctgggtaggtttggtaaaaagtccaaagtcagcaaggatcagatggccgagatgaatcgcaaagaacgcgtagaggcttggctcaaaatgatcaacgatgcatttggcacactggacgagacgtgcggcaaggtgtcgtgtgtcagtgaggagaatctcaagtttgtatcgatgcagtgtaaaatgtccaaatttgacatttccaacgttagcgtcatgggggctcagttcaagtttggcaaacgcttgttcatctttaccaagatgcacgatgcggcatcggctcagattctaacactggagggcgatgccagggacatgattgtgtccagtgtaaacaaccaagtgaccggtgtagatttgcgtctatcggacgtggtcaagatttgtgcctacaaaaaggttcaaacactgcaggcctatcagcgtgccaagaatggcttcatggtaaacgatggagttcgcaagtctggaaatgtggccattctgattgattccataatgttgtcgcctcagttgtcgtctcagtatggagatcaaaacataatcaaactgtatccgctacgagtgcaaaaggtggattgcagcatgtttgactttacctttgacgaggacgatgatgatgaataggatggagggggtttttgtatggtgttgtattagagtgtttttgtatggtattgtattagagtagttgcatttgtatgtattaagagttgtatgtattaagacttgtatgtattaagatttgtagagttgttgataaaataagagtttaaaaaatatgtattctgtaatatgtattctataacattagtattacttgaataaatgtagttttttgatacaatagtatgtctttatataatttttaactataattttaaatataattttaaatataattttaaatataattttaaatataattttaaatataattttaaatgtaattctaaatgtaatgcacatgtatggttatcaataaaactcaaaactctaacaatatttttttaatctctacaaacgtgaacctctataacaaacatccatttctaccttgaacaatccaacccactcatcctatccactcaacctatccactcatcccatccactctcctctaccttaaacaatccaatccacctaaactaacctacaacaaatgtgccaccaactgatccctagtcttgatgtagtagtcggcatagattcggtactcgagctccgactctattgaactcttgtcgacattggtgaatctgtaaaagtctacatataacgcagtttgatcatcagtagccttggtggtggtagtagtagtgttagcatcagcatcagccaccaagagtgcaccggcagcctcaatgtgcggtattgcaaagggtagtctaccggccagttttgtcttgagcgattcatcgaatcgtagcatgtcttcgtcaaagtttaacaagcacactagacgtttgcccagaggcgatgtgtgcaccgaggtcacatagagtgcctttagcacagtcataaactcgtcgtctctctcagagggcggtgtcgaatggtacagtttgaccagttccagttccttgagcctaaagaaggttgcatagtagagtgtcacgtccggtgtgttgccgcgtatagactcgtaggcatacctcgcctgttccacatccaccggcagattgttgattcgattacagtcaaagagtacaaacttgacgagttcattggcagcggaaacttcatcaaattctgtacgtttgtactttttgcacaaaatgttaaacaggtacgatagatcacaactcttgcccattatagtttcccagagtcctttgagcacgagtgcagcatcgatatcgcccttggtacgagtcatggtcagttgaacgttggtggcgtctttgatgttgtacggtgccagctgcagagccaactggagcacttcaaagttgccaaatctaaacgtcaactcgaccagtgtctgggcgtactccatcagggcacaatagtcgtcgctggatatcttgtccaactctgtatcgtgctcaccaaacgttacaacggtaccgtgcgtcgaaccgtgattcaacaccagatcgggtcgcgcctcttcatcggtggcggtggtgcgatcttcaaacactcgcttctcgttgagcaagtgtatagtgtttttgttgactctaaaattcaaactcttgttgtcctcttgggaattgtacacttgtacactgtacgtgcccacatcgggaaaacactttacaatctgattcacggtataggcacacctatcgatcaccatggactcgggcgcccccttgacgatccttttgaaaatgtactcgcaatcggaccgggtgagtttgggtttgcactttagcaaggcgctgttgtagtctacgctcagaaagtacaaaagactagagtagttgacgttgcgctcggtacgatgccctctgggcagattggtaccgatcgcacgcatcagtccgtaacagtagccgtgatccagctgctgagcatctgcattgtctaggaacgcgtccacgtagtctgaatcgtagctctcggtggcatcgtccaagatgcactcaaacttggagagaatgcgatcgtcaatcgatgcagtctgtcggtccagttgaatgcacttgtacagcacagccttgaacattacgaatcgtgcactggccgtgggcagggctctaacgccggccactgcagtgactagggacacgtttggattcagcgtcagatagggaccgtgcaacgattccggatcgtgcttttcatcaaacacatagggcaatctatagttgagtgcaatgtctgtacaagagtcggcataaaaggcaggtgcagtattcttgtttttgtaggagcatgtttgaacagtgccatcctcgtccgagtccaaagttacgtttgcaaggcacgagtacagattgtacaattccaattcattcaaacgtataggagtctcttggtggaggttggtaatctcttggattacggcactcgtatactttgccagattggatacttttagtgggtactctagagtggaggttgtatcgtgcaacgactcttttaagcgttgcaggatgcctactaggctggctctgctctgggccagtactcgcaccagtagccgattgagtgccagcgtcggtatggcatagtgtctagtcttgctcaatcggtacatgtcataattggtggggtgtactcccaccgatgagacgagttcattgtacctgactcgatgctcataagtgtgttgggaatactgggattggttgtgatgttgttgttgttgtagttccatttgatttgtataggcaactctatagagtaacgagtctacaaggttacaaagcttagtgctagtttaatatcaaactaaatacaaagccgtgtcggtgctttgcattgctaaaaaaataaaacaaggttcggtgaggttgtctcaaaaataagtaaacagattctacttttgtataggtatttattaaagagttttagtattgttaaaatatgtcaagtattgttaaactatgtctatggcaatctatctatccatctatcaaagagtctactgtcaaaaatacaaaatgtttacagtgtaatacagtacaatataatctaaaatgtaagaaatctaaaatgtaataaatctaaatctaaaatgtaaatctacagacaaatctaaagacaaatctaaaatgtaaatctacagacaactctaaagacaaaatctaaaaatccataaatcaatccattacacgtgcactccttaaccatcatcctcctccacctctacgcactctttccagtcttgcaaaacagcttccaatttgtctgctgcgtaaagtacataaacagagtcagtgccagcaggcagattatggcaatcttgtaaaacagtgtaagctcggcaaatatcaatataatgattgatatggccaccggtacaatcacgagcgtaggatagcaaaactgcgacagtattgtagttgtggtcacttccttggcgggagtttcgctgggcacctttgacgagctaggagtggctgacatgatgagttttctcttcttgtgtaaaactagacccttttcaactaggatgctatccatgaataaatgtatcaaaagtcgtacaatgcatgtgtctaaaaaatacaacgggtatactttattacaaaacacactatatacaattttcaacatttttagatacaatgtcacgaatctcatcacgatagtactcgggtatatccaacggctgatccatgtaggctcgttccaaaaactcggtaccaatggccagatgccgattcagttcacgaatgataatctttgcaccgagtccgtccagctccatctccgattccacctctcgttccagcttgtacgagtgcctgccgccctgacactgaatcatgtgtcgcacattgccatcggtgataaagtagtagccgattgcattcttggtgaccaccatcgattcggtgggctcggccagtttcatctctcgagacaccttgtagctgcacttgaggtactcgtccacattgtccttgtcctcttgcagtacaatcttggcatcgtactcaatgttgttattgtccccattgtacagagtcttgcgcacaatgaccggcaccgaactatcggaaaagtccaccattgtattgtagtaggtgcgatccatcatccgaatcggtgcgtgattcatgtccaaaaagtttctcgtagcatacagcgcagagagcaccgtctccagcgacagctctggatactccaatttgcgcttcatggtccactcaatctcttgcaccatgagcgagtgcgcatcctttgcagtcaaagtgtcagtagacactcggacgctagaatcgtcaccgacaatcgttagaatcatattgttgcaataaaaacaaaggctagtacaaagactaatgcacacgaccaacgcgaatgcttgataaaacctgaatgaatttgttcagtttatatatgctccatttaaacacctactagtgattattactgcaatacttgttatgcgtttaatttcaatagactattaacggtatgcgtcaacgatactttacagaaacaacatgcagatgcaactatgaacgtgtggatatcgtttagtaccatttttgcgctatcggtggtgaacattgccattgagagtgccaaggctcgaaataggataaatttgtcaaaaaacaagtttgtctacaatccatctgagcgacatccgttgttgtagcatcatggattgcaagattttgtccggtgaagagttgaccaaagaggctcaactctttatcaaaaacatgccagagggtttcactctgacgaatcctatgcaattgtactatggccacaagattcaccggtacgcttggatctctacgccaccgttcaagtttgacgaaaagactatgactcgcaatcgcaacggtttgtttataaacctgctcaagtatgcgagatcgctgtatgcaaaattaaacattaacgtggtgatttactacgagtctgatatgccgcctctgtttatgggtaatgataaatcaatcgaagcggtaatctctatgattccagcataccgtctgcgagcagtgacacatgcaacgtggaaggataaggattgattggaggtgtaattatacaagtattgtagagggtgctcgtacaattaatatagagtgtactcgtacaattagtgtagctaatagatttaatttaacatttgtatcaattatggatttcaagatttttataaattgttttgatgaataaaaatccttgttttttagtaagtcaactctttgagttcaagtcttattttttacacaaaccaaaacttgaacgcaccaccagtgcacgctgcctcaatggagttttttaccattgcatcgctcgtactcatactggtgtgcgtgacctacctgctagagtgtgcacgcaagagttttgaaaagtataatgatgaaacgaaaaagttttcatggggccgttataaattcaagattagcgaaatcgaggccaagcacacggaatctaataaagattctaatttacaacccagcaacactgtaacaaggtttaaaggcccctttcaaaacattaaatacaagaacccctctacagatcccgtaatcatagatccgggtcagacgaatctttacgagtgcactccgagtaaacctaaagaatgcaaattgtccgatgccacttcgtgcatgggctgtaagaatctgactgcacgatgcgtccacctaaaggaggacaccgactacacagacaccgaaaccggtcaagagtttaaactggccaagagcaagaccctcgacgacggttattgtctgagtgtgaaaaaggttgtagacttgtgcaatcccaatcacggcaaactggcactggtcttgtacaatagggacttggacgaggaggcctacaacgagcccgaggatgaaaatcaaatattctacaatctattgtgtgtctgtaccgagccgggctacgtgggcaatctgggtctgttgggttcgtgcgaggatccctttgtgtgcaacggtaaggttgtagacattaatgtgcccctcaccgaaatggtttgcgagtgcggtgacaatttcgagtttatgcgcatcaacggactgccaacgtgtcagattaaatcgatagacaacatgacaccgaccaccgagcccatagtgcccggttctgtgtccaaacagaggtaccacaaaacgatcgcagccaactacaccggtgagagtctaccgaatccgtgccgggtgtgtcccgtcactggcctagtggtggacggagccatcattgccggcaaggacggtagcgttcagtgtcagacgtactcgcaacactatggagtgcccatacgcagattcagagacgaacgcctactggcaggcgatgagggccccgatgcgattttggccatttccaactacaccgtagacgtgtacggctacctagaggacaccacctatcccacgctgggcataaactttacccgagacgacaacaaagagtttttcgatgcgctcaagattgacaaggacgagtacacgctactgattcgaccctatcatcaggtaaagtttccgggcaactttaagattaccgatcgcctgtacaaggtgcccaatctgaaactgtacgagtacacttggacgtacgatttcaaattgcagaatccggcccccgagtctagtggctttgtccagtacctggatccgtacacgttcaatctaatgtacgatatgctgtccatgtactatctgtggggtcggacgtcgtactatacagtcatgaatctgaaaccgtttgtcgtgctcaaaaaggtcaacggtctcagtgtgtactcgaacaataagaatctggcaaagattaacgatgaaactatgaagctccgattcctattctttagatttgacttttcaatggatcgatcactagtcatgttgactgccgagaatcgatacgattgggacaagtatcacgcattgcgtataaaggagggtgaatgcggtggacgaatcgtacgcggtgaatgcatagatccatttggtgtgtagactgaaaattacttgaatgtttaaactctttgtttacttgaaatgtcaatgttggtatttgtactagtagtagtaatattgcaccattaattctaataaataataatagtaatagcttattagtgttgtaaaactgtagaatatagtagggtctttgcaaactttacgtgtctataggtaaattcagacattttattgctcaactttaacttgtaacggcatcatgtacaagcacattaaaccgatgcaaagcaagctgcatcagtccaacaaattgaatcagcattttataccgacacctagacctctgaccgactacaagtgtatatgcacagaggcgctggaaacgtttgccgtagcgcctgcgtccaaaaacattgcactacacaacgccaccattctttgcattctgaatgcgtacaaacagtatgtgtgtagtcgcagaacctttctgtccagagaggagctgcgcgagttggatcggtgcattcaggcggttcagcacaactttaatcgtagcgtgtgtgtttcccatttggattttgaagcgtccgatgtgatgctttgcaatacgagcaatagccgagtccgactgcccattgtgcgtactccgaacaatgcacagtctgtgtgtcaggctgcggccacaatgtgcggtcaagagattctcaagtttgtaatgagccattccacacccaatgccataaaattggaaaaggcacaacctgaggccagtgagaaaaagattgatctgaagcgcatagccgccaagaatgatggtggtggtggtgacaatggcaacattacagtgatcaatgtgcaacccaaactggtacaattgatgaagagtgccgaaggcgatattgccaagttgacggctttcggttagggagtgtgtttgagagatttaggttttggtagttgtaggatagagttggaggttgtaggatagagttggatgttgtaggatagagttggaggttgtagttggaggttgtagttgaaagttgtatcctagagtgacgagtagagcaatgtgtgcgtggaggttactgtttgattatttgtgtaggagtttcttaaatgtaattcccaattaattttgtacttgggttaaagatttgtgtactttcaatttgtgtactttcaatttgtgtagactttaaattgatttatatagcatacctcaataaatataagattcttgatttgtgttttttagcatctaaacaaaaaaaagaacatttattacacctctctgagacttgcaagtctacagtagcatttattcgtgaccgtaaactctactttacaatcatataattaccatagctcgggtaattttacttggaacggctctttatgcaaacaacaaatattatgccaatttaaagcaacccatgaatggggcaccataattgtgtctataaaatgcacacaagacttgaggggtaataaaccgaatgctgaatgcagattgtgtgtgcatgtttggggtttaaaatgaaatgtgaataatgctcggattaaatggttttaaaggattttgaaggattttaaaggatttagtatagggtagtagtaaagtgaaaaagattcatttacttttaaatgtttattttttaaataacaaaaaaatactttattgtttaataatacaaactatgtagtagtgaacattaatgcttacatctaaagtgcagaataaacacaactctaaagtgcagaacaaacgtaaatctaaaatacagatcaaacctcaactctaaccttattctaaaatacaaaacaaaacttaaaacttaaaccatcaaaacaatccatctacatgtgaaaagtcagcatccaaatctttgtacgatcccttactaatcccagattcctctctgtcgatatcgtgttcaataatagaatcatgcacaatccttgaccttttcggatcacaatcaaagctcagtttgcgtttgcactttaaatttccaacagagtgccgtttgcgtttacgtggtgcatccaacaaatttaaaatctcttcatcatcacacaactcaccctcttccagttccgagtctacataggaacgtttgactgtcttggatttggacttggacactgatttggttttagaccgtttagatgaggtgtgtctagttttggtctcagtgtatgtgtattcaaagtcctcctcctcttcatcagctggcacatcaacaggccacactgcctgaatctctggcagtctacgattcagttttggtcgagtgattggtttcagtttgttaaaatggttgttgttattgtggttgttgttattgttactattgctactcttgttgtactttttataattcttaactttaaaagttgtaggatacgtctgatttagagtgcacgacttggtgtacaaattgttattattgtggtggttgcttttgttgttgttactattgtacgagttcttaaaactcttgtagtgagacctattcttgttcttgtagccttgatgcttattcttgcaattggctctgtacgtatccttgtactggtgtacactgtcctcattattgtcatcagcatcatcatcataatattgcgtgttgttgtattgattagttgcatgctcaacctttgaattgacccatttagaattaccataagccttattatcataacaatgttcagcattagaataaccagtagtggatcgtctgcgtttacgatgcaactcgtcattgaactcggcgtgatccttgtacgagcggtcatcgcaatcgtactcttgtttaccgtagccgtcctcagtgtggtactcgcgttcgacagagtgctccgaaacgacacccttggtggaatcgtaaaatggtgttttcattgactctttgtccttgtagcctctatggtttggtttggtggtacggtgctcatgtttggattcataagaatggtgtctggagttagatttagagttagagttggaattagatttagatttagaatgtgatttggatgcagaatgtgatttagatgcagaatgtgatttagatgcagaatgtggtttggatgtaggatgagttttagagtcagagtagcgtttagcgtccgagtgtttagagtccgagtgtttgtaatcatgatatttatactctgagtgtttggattcagaatgtttagaatcagaggttttagaatgtttagaattaggggttttagaatgtttataatcagaatgtttatattcaggtttacaatccgagtactcggaatgcttagttttgtcactattggaactctttacactcgggctctttacacttgaactctttacacaaatatcactctttgggctctctacaacattttcataatccatacatttagaatcaacactacctttagaaatgctacactttgactcgctacctttagaatccctatccttggaatctttacaatcaatattctcaacattggcatcctcagtgtaatcaacctcagacaaattgaccaaatcatcatcctcagctagctcttgttccaatgcacactttaacatgtgcagtggagtgtctgaatctaggctatagtctaggctgattgattcagcatcagattgtatcggctctattggcaacggtgtagaagtgttgcatggtggctctttcaaaacattttcactatcctcttcaatgggtttaatgatcgactgtggtctatcatacttgtacggtctagcatatcggttattgttgttgtaaaacttggaattgtaattataaccattggtattgttattgttgttgtatctacgattgttgttatagggcgccttgtaaggtgtaaaagcagatctgtttggtgctttgctaatggtatttttgtaggagttgtaattgttttgattttgattaaaagaatttggatgattgaatgaattgttaaagttggggttgttgtagttattgttgtagttgttgttatagctactgtggttatagttattgttatagttattattatagttgaaattgttgttgtcattaaaaggtacattattaggatagttggtgttgctgttgttgctgttgttgttgaatggacacggatagggagtgttattattgttataataattgtttgaattggaataaaggtttggataattgttacagttttgatagtttggaaaagagttgttattgttgctattgtaattgattgaactaaagctgcaattgtaatcgttgcaagagcaaagagtcggttgcatgtagttgccattattaggatatccagaattgggaaaagagttgctaaaagagttgttaaatgaattgaaagaatttggattattaaaagaatttggattgttaaaattgttaaaagagtttgaatcaaaagagccaccattgcaattgaaaccagaattgttgggatggttaccatacctgtttccacttttaaaattgttaccattgttgtaattgtagttgttgtaattgtacgagctgccacctccattgccattgccattatagccacgataacacaatcctaaacctgaaccaactcggccaacaatcacactaggagtctcgatacccttttcgttatacattccgccattgcacttttcaatattgtacttttcattacacttttcaatattgtacttttcaatattgcacttttcatcggtatcctcctttagtttatcggccagagtggtggcctcatcgtccacagtctccacgtccacattgcactcgtcttctagattcttgctcctcagtacactgtcgccaatgtgcatgcattcgcccaagttgaatcgatgcagtatcgaatgaaacacatgtcccacgcggcaatgaacgcatcgattgcggtaatgaatgtccacatcggggcacggatagttgttgaagcagcttccaaccagtgagactttgcacaggtacaacttgctggcattctccacaaaggtatcgtaccaagggtagccgttgctctgcaccagattctgagcatcgtagacgacaatcagatcgcacgacttgatcacattgtaaaagctgccatagttacgattggtcatagccacctcgggatggttcatcgtaacggtggcatagtcctccatgcgctccacgagcatggtacacttgttgtacacgagcttggaaaccgaggctccggatgcaccgttgcagatgcgattgttcaaacacttggacactacggaaaagacaatcattgcgatcctgactcggtgacactcgtccgatgagtgcaccttgcacgtttccagtttggacatgctctttaggtgctcgttccaagtggcgagccattcagtcttgcgattcattgccgactcgtcttcggcatcgacaatccaagagactccgacctcgctcagtttagactttagcgtttcgtttagagtttgagggccgacgatgtagtcgattatgcgctctccctgataggtgggatacgctacaatggaacgagtcacattctccatcatcagttgcttgagttgccgcagcgattgaatcgactcgatttgacgatactcgaatgcattggctgcattgcaaattttattgatcctctccaactccacttcaagagtaatgtttacatcgtcgtcagaagaggaggaggaggatgaggaaattgtcgaggatgcagatatagaggccatggttgattcaaaagccaaaaattaaattggatcagacttgttgtcttggggacttgcaccacaccactggtactgatagtggtcgtgcaccgtacttttaaagcttatctctactacattttatgttgaaatattaacaatacgctatgggcaatataaatagcacaagtttataagttgaacatcaaacgttgtacggacgttctacagtatacatctatacatatactaatatcaacttgaaaaatgtaccaatacacggacgttgacgatttggatctcgtttcgagcgaactccaaccgagcctaattgtgcgtcgtaaatttgaactggagcccaatcggtccgtgtatctgatcaatcggtactcgtgtgtaaagccactgaatcgcaactatggcgaatacgtacataatgtagtcgaatttagagactgcgacctagagtatggtcccgagtgcctgcctccggctctgcgcgaagtattctaccatgtcaatttcaagtatcgctcgtttaacgtactgcacccaaactcggacttgtacgcgctaatgtgcttctttgagacggtggttgtcgatttggaaaagtgcatcgctgccaacgatttgctgattgacgtgtcgcggatccttcaaacgcttctggtcaactctaaactcaactatacgatagacacaatgttcggaccggtgccgtggaacgatacgattttaccgattctatcgatgccgctaccggcagagtctctggttcgttacaagattgataggccaaagattagcctggggcaaactcttcccgaaatggatattgacaagatttacactcgcgactatttgatgagcgtaataaagacgtatacgacgggtggcgtcggcaccgatcgcatcagcgacgacactctgactagattcgtaaagcacactaaaaatatatcgccagctttgaacggtactgcgtgtgtgggcaagagtacaattctgcgcaatattacaagctgcgctcaaaagagcctggggccagattttgacggtaccgttcaggtgctcaaactgtctcagtacggtggctttaaggacaaggacattaacgatctcgtcggtatgcaatgcctgccagtgttgatgcacgcttgcgaagagtactctactagcgtcacggataggtgcgtctttaacaatataatctggaaactcatcatgtcactgtttgacgcgtcctctgatcaagaactgatggagggcgcctacaaggcattgcacacgctcaatctgaatctactagagtttatgaaaaagtttcccatctttgtactggtcgactcgtcgatactcttgaatagaaaacgcatgtttaaccgaggcgttgacactctggagaagagcgaaaaggttaccggtgacttgtttcgttgcaagattgtaccgtatgtcaaggctcagaatgtgatttatggcacactggccacgctgtgtgactggccagtgattgatgtcggctacaagtttccattgaccgcagattggatgtctatactgacgaatacgttttgcaataaactcgttgaaaactacaaagtatcaaaagctctcgctctcgccgacaacataagccgggattttgattgccgcggttcctacattgaagactcgtacactagagactatggccaccgtccaatggtggacgagtccgaggagccgccagccaaacagtctagactggacgatggctctgccatgcacaagtacaatactcgcagcaaaccctttcaagaggtactcgtaaagagcgaggccaagagtgtcgagatcaaaagcaacagtagcaatcccggcaatggtgcatcaaagagcactcagactagtgccagcagtaccagcactgcagactcgcagagcagctgttcctctagctcgaccgattccgaaatgaattttaccgaaacaaccaccgacactgaagactcggacacttcaatctcagaggacgagtccagcgtggccaccgttgtacccaaagagtccaagacggatgtgcaaaacaagatgcgcaactcgagagtcgtgtacaaatatagacactctgagtatccgattctatcctatttggcagcaaaggcgatgaaggttttcaagtaaattgtactcgtagaaatttgttatgtaaaagcaatattattgtaagcaccaaatgtacatgtttagtattatgtttgattgtttgcatgcactctatgtatttagcaactattctaaacctcttgtaaccttttgaaatcaataaagtctagttttttaagcactctattgttgttgtaagttgaatgatgaatggaaataaatggtaaaaaagtacacaagtctttgattgctttaaaagtatcaatgtaccagtaccaacactaataccgtattggtactatatttggttgaaagtctaagaggcgccatcaaaatgaactgtgcattggtaatctcgggatgtctcatcggcgtcgtgttgggctccatgtccatgcacgccattataaagttgctctttataatactgctcctgtggacgacatggactctggtgcagcagcacacaaacactctgagcgattggttttcgtcaaatgtaatgtctgtaatcttgaccaaactgatgccaccggccaagaccaactcggtgaagccctttaaactatccacacccaagactcgaccagagagcccagacttgagtatgggaccaccgcccaaagattttgcattcaacacggccgtaccgttgaacgcaaagcccaagtctcgttccagatccaagtctaggggcgagagtacagagagtgaggatatgttgttgtagaggtttttgaggtttactttagaggtttactttagaaggttactttatagggttgtgttagatgtagtttattttaaaggtagaggtttgtttagatacagtttactttaaaagtttgtttaaataaataagttgatttatagagacgtttgatagtattactttagatgacaacaaaatgtaactgtagagtttaggcatagactcaaattcaagttgttgaattcttgttttttaagattaaacatttactcttggatgtagaaagacttgtaaattgtacctttatttggacatggaaaatccatctaaatttgaatgtatgcgtgtttagtttaaaacatagaaagacctagatattgttgaactctagggttaccgataacaacgtgttgaattggtataaacattattacgcatagcgtattatctatactcatccgtgcaataaatacagtagacttgagcggatagtcatcagtactggttgagccactataccggttagagtaccattactaccaagtactcgtactactactactaccaactactactaacccctctacccatctatacttgcaattttcaagctctaaactctaaaccacaccatgtcctctttcctctccatgttcaattattcggcaccttcaagtgcaccggacactgaactgccggacactatcgatcggtgggtcattctaaagattatcaacgacactcggcacatactagtggatcgattccgtgtatctggagagtgcgttgcacgcatcatacagtacgtggacgatcacattggcgatcacgtttccaaggagcgctttgaggaccacttgaccgagattaagagcatcatcgcccaagagtctatgctactgggctcgttggccgatgcctttttgggctccattctaaagagtaagattatcgaagtgtaccagtctacgaaacgcaaatcgcagcgtggatacgtaaacattgacagtgacggggaagagattgaagacgaagaggatgaggacgatgattccaatgatgttgatccagatgcttatagagggcacaattcagatgacgatgacgatgatagtgactctgatggaggtgccaacggttctagagattgcaacaatagcaccgacaacaagtgccagaaagagtatgaaaatcaaaaagagtcacagggtaaagaattcaagggtaccgagccatcaaacaagcgtcgattcacctctgacgagtacgtgtacaacattaagcgtttccgcagcagtgaggaagagtttgaatctgaccaaatgccgaatgcgttggatttgaaagactactatggtgacagtaccgatgaatccgagtctgaggatgaattgaagactctagagcacaagccaaaggaggttgatatttcaaccattcttccaaagggttaccgtttggttgataacaacaagttgattagagtcgactactataactttgtgaatgagcctacggatgagcctgatgaggagtctgaggaggaggatgagaatgaggatgaggataaagtgtttattagaacgtatgcttcaaatgtttaattgtagagtaaggtagagtaaggtcaagtacgttgtagtttgcatttgaagggatctttaaagtttgtgggcatctaaagtgtaattgtaacaattgtaattgtacttgtaattgtacttgtaattgtaattgtatttgaaattaaacttaataaaaacactatgtgaattgtagatttttgtatttttttgtataccaaaaaatattaatactaatgaatacattcctaaatacacttgttgaatacattacctccacccatttaataaatacattacttaaacacagtactaaagtctctacacaatcctataccttaactagctaccgctctggatacaatacaaaccctctctctaaacacactaccactctggatacaatataatcccactccaaatacacatacacattatagtaatctccccaacaccactacaaatgctataatgaccaatcttctaaaaatactataatgaccaatcttcggtattggtgttggctgcttgcaactcgtcaaaagtcacaacgccagcctgtctgagtgtaaagctctctagctctctgagcagtcgttccaagtctcgcaccgcctcagtgtcggccatcgaacccagtacggtgagtgcattctgcagcttggcaatggtttgaatcgaactgatgcgctgcgatgcattcagcgttttgagctcgtccaacagttgacgcatctgttcgggcggtatctggctctggccgacctgtcgcactccgtccaccacctgttgcattatgctctgtaaacgctcaaagttgaacatgctcaaaaacttgacaatttcctcgttctgagtgagcaagtttcggtagcgttcatcctgcaccttttcgctctccacaagggcctgcataaagttttcaatgttttgattgactacattttttaggcgtaccgacaatcgatccagcagaggttccatatagtctaccagatacgattccaggctagtttgtatggcagcctttatggcgtcaattttaggcatattgttactactgctactactaccactaccactactaccactactcttcttgttaccctcttcaatcaaacgagtcaagtgatcctctagcgcattgatttgcttttcgtttgatttggccatcgagtctagtcgatcctggagtgcatcattaaagtggtggtgttggctcacatcatcagcattacccttgaccggttcgtgtatagtctgcgacaagtcattgatggccaactccattagattgagtttgtcattgatcgtgttgagcaagtcgatgacgtgcacgtccggcttggtctcttcgggctcgagctttacaccgtccatgtagctggccacgttcaatttcgagtctgattctgggctacgtattcgattcagatagtcggcatctttacgatccaccatggctgcaaagttttcataatccatcataccttcatatttgctagaatcgtactcttcaatctgttcgagtggtcttgcattcaaagttccattaggcacttctacaatactatagtttgatggattgttgtcattattagtactagtattagtattcagaggacctacattctctacaaatgtaggcatcggtagattgccaacatccctagcattaccactacctcccccttgcactccacgtacaaccacagacgtaaagtccatcggtacagtgtacaatgtctgtactcgatccagactctgcaacagtctatcggatgcggtaataaccttgttgtaaacatttacaaagttcaagtaggtctgtatcgagactcgtttgatgtttagggtgcgaccgacgattcgtctcagagtagtaaaacttgacgtgtcatatttcatgcctgtggtgatcaatgtcaagtcgttgagttgatcgctaagggtacgcgacgcgtgtctgtattcgtcgttcaaaaaggaatgcaagtcgtacaagtctacagaatcgcgcagtagctttattcgaacagagtttattttaccctgagccttgtcgtacaacggctgcattgaattgtacatgcgcgtgattagatgaatcagttcggtcgttgcactcttaaagtttttaaatgtgtactcggtcattgttgcacagtcgcacaagctcagtttacactgtatcgatcagtggcgctagtagtctgccgtcgggtgtgtctttgagttttttagaatcagtgctcggacctttcttgtaatattcgcacaagggaattgtcactaatcgctctacaataaccacaaagagggcaacgaccagcaacaatagcagcattgtgcgtgtcaaatcatttgtgaccaatctcaaacaatcgagaagtcgccatttaatggcagcgcctagactacatgtaagagcatattggcgttatgcgtatatgtgcaaagttttaaaggatgataaacgctgtccgttttattcagactagtgtgtcagagcaactcgtgtattcatcatgaatcttggaatgctagtcagtttgatcgcgttgagcgtggtgtgcatttgtaccgtcatcttgatgtggttctcgttgcatacgttgaacgccaccaagattaagacaccacgtgaactcgcagactttataagcactcatatgaaaaagaatggcacctttaccgtagcgtttacgtatcgctacaacaaggataccaacaaatatgaaaactactatgtcgacagtttgggtaagctagtgcgcaaatacgaagacttgccgataaacaatctaggcaacccggtcgacaacggtagagtcaacaacaagcgcaaggctagagacgacgccagcggtgccaaaaagcgcaagggtctaatagaggacgtgtccgatgagggtttcacagtgaccaacattgaaggtatgttcaagtgtccggacaattggatctggcgagattcggaaaagatgtgcaaacccaaagctatatgtcaagtcgacgacccgatcggtacaatcaagggtctgccgaccaaggatgcctcatcgcccacactgtaccatccgcgcgtgtacgcagtgtgccagggacccaccacggaaccggtggtggtcgacgatgccgactatgaatttagggatcagctaacttctaacccaaaagtcaaaattaaaactggtcgttgtataaacaacaaagtctacaaccaaaaactcgtaaaccgtgccggtagcgatccgtgcgtattttatgacgtgtgtcaaaacaaagaggacggttatactcatgccgataaaattaacgattacacgcctagcgaatatgaatactactcttgtcacaattcaactagcgtactcaaatcgtgcaaagccggtctaatttatagcaagattcttaaaacttgtacttttaggaatttgtgtaacgacaaaccaaacacgtttacgctaaagattgacgatactcgtttcctaaaatgcataaactactcggaggccatagtgtcttgtcgcgacggtatctacacgcatcccgacggtcggatggagtgcgtgtcgttggcctgcaaagcactgtacgattccaatccggagcatcatttcagagcgttggagattcaagactaccggtacatgtcgtacgttagcgctatcgaaaagtgcatagacaacaagattcacaagattgccaccggtaatcgatcaatcacctacgctctggaaacgcgctccggtgaatactatacggttacgcgcaaacgtctcaccgacgatccgatccgagtgcccggttcgattatagacaaaactggccaaatggtcaccgttggcactctggaggcactcagactgttggcggatcaattgattgtaaccaatcctataacgattcgctacaactatgcatcgccgtggttagagtacgatctcttcaagggtaggccgtttaatgtcaaaaagtggaatcgcgtcgcagacgtggacaatccggttagcgtttcggtcagcgatacagacaaggctatcgtcttttcagaatactatgaaaacattgagaccaaacagcgggtaccgttcaagtcggccatgacattctacagtaccaatagaccgtactttttcaaggatcccgacgaggatctggtgcacaaggaactggcaccggacggtcacgtactgtgggcaatgtttagacgcaaacgcagtcagccattggacatgtacagcctgtccaatctgttgacgacaaagggcgccttttacgtgaccgaagagtttatcaatacgggcatcgttcgcatggtggagggtttgccgtttgacggtaaactcatcaagaacggtaccgtgatagagtttaaagtgtttatgaacgatcgctactacaacgttaccgtaccgatagccagcagtcaacaactgaaacagtttctagtcacaccgtcggtggtgcagccgggttcgtttaaaacgatcgagtacgacgagtccaagtttgactatgacacgtatcgatactttatagtgaccaacattatgtttactcaggaaacgtttgtggagcacgccttttcggccgagtctgtaccgtgcgtgtccttcttcatatcgctgttgcctctgtccataatgggttggttgggtgatgtcaaagactttgactatcgaagcttctttacacaggacccaccgattggtggcagagagcgtcggcagaatatggatacggtggcaccacagattgtagaattggttctacctcccactttggaggaggtggacgagtcgattgacactgacgaggtcgtggacgatgctctgcgtaggcgcaaatctagaatcgtagactctagcgagattgctgaatttgacaaactgtacaagtacacgcgaatggtactcgattcgggcaaagaattgaaacggcccgatgaggattacgatgcgtttgtggcagcgttgcctagtagaattatggaaaagctagagagggaggggaaatagaggtatagtttgaaatggaggtatactttgaaatagaatgtaaaaatataggtagtgtaaataaaggaacgtagtagtagtagtattactagttttagattgtagactatgattgtttatacacacaaatacaaagagagagatcattaaaactgttgggtataggatttggtatacatgataggtttatagaaaacaagagtacaaactaaaaacacacaatactggcacactggtacaactacaggcacccgcacactttcaggcaagtggccgcatggtcatcaaatgggtggtttttgatgtagtgttttatagtgtgtgttgttgttgttttgttgaatgttgtcaattttagtacatgtagatttgtagatgcaggcttgtacacaattgtaaagtatagtagatttgcatgtacctatagtttgtgtagtttgcttggagatttttgctttgagtattttacaattgtaaaggttttgattattttgatcaagtatttaaaatacacaaccattggtaaactacacaaactgaagcaaaaaacaggtagtgtggtgtaggcatagaggcatgcgcgtattgggttacctttgtttggtttgcatttccaagtatgcatatgtgtatacatatatatatttatataatgtgtaattataatgtgtaattataatgtgtaattgtaaatgtattcttcccattctattctattcaactctactctttatactaacaaacttgcacttgctttaaacttactaacattcacactacttgatttgatactgactaaactaatgaatatctcttgtatgtttatagatggtgacgactcgggaaaggacaaagctggggacacggacaaagctggggacacgggtaaatctgtagagggaaagaacaaaactctagagattatgaatcaaactatagagaccaagaataaaactgtagagggaaagaacaaaactgtagaggaaaagagcaaatccaaacctgccgaggataaaaccaaaccggcagaggataaagacaaggggacagacaagggcaaaggcaagggtaaaacgactgaggatgaggttgaatctgacgaggatattgacacagacgttgacactgactctgatgaagacgaatatactgaccatgatgaacgaaacaattcagctaaagcctttttgggcgcgtttgctgaatatgatgaggcggcggccaaagcggctgaggagaaacgcaaaaaggcaaaagagttggagcttgctgatgtgcctaaagtgaaggatggtgagggttctaaagcaaaggatgaagctaaagcaaaggatgaagctaaagcaaaggatgaagctaaagcaaaggatgaagctaaagcaaaggatgaagctaaagcaaaggatgaagctaaagcaaaggatgaagctaaagcaaaggatgaatctaaagcaaaggcaactcctaaatcaacagagaagcctaaagcaaaggatgaatctaaagcaaaggcaactcctaaatcaacagagaagcctaaagcaaaggatgaatctaaagcgaaggcaactcctaaatcaacagaggaacctaaagcaaaggatgaatccaaggcaaaggcacctcctaaatcaacagatgaagctaaagcaaaggcaactcctaaatcaacagcggaccctaaagcaaaggaaactcctaaatcaacagatgaagctaaagcaaaagaacctcctaaatcaaaggatggttctattcccagctcacttgtaccagattttgaaagtgagccagattacgaatcggatgaagacgagtcttccgagcacgaaataacttctacaacactattgaatgcgttcaacaaattggacgaagagagtcgtaaggagtctgctggtagcactggtactagtagcactggtgttggtagctctggctccggtactggctctagtactggtggtggtggcaaatttgccaagcctacacccgattctagcacaccaggtaaagacaaacgagaggttgttagaatagacacggttggtgatgctggctctaaatctggtactaaacatgctgttgttaaatctggtattggtagctctggtaaaggctccggtactggctcgggaacacctaaagttgcagtagccgactctagtgttgaggatgaaatgtcagagggtgaagaggatattgatgaatttgatgaaacgagtgcggctgaggcagaaaaggctcggaaggttttgcttgaacttgaaaaaggttctgttgctggaggcaaagctaaatctagcgatgtaggtgatgctaaagtagatgacaaaggaaaggaatcaaagagtcttggtaaaacagaggacaagggcattaaagtagatgacaagggttctaaagcagaggacaagggtactaaagcagaggacaagggtgttaaagttgacaataaagaggaacctaaagtagatgataaaatagatgacgaatcagacgactctggtatggacattgatgaatctgatgaaacatctgaagaagaggcagaaaggaatcgtaaattgttaatgtctacatttgaaagcttggacaaggaaaagcctgaaaaagtcaaagttgacgacaaggcaaagactgatgaaaaagcaaaggccgatgccgcagcaaaagccaaagctgaagagaaggctaaagccgatgctgctgcaaaagccaaagctgatgaaaaagcaaaggctgaggagaaggctaaggctgatgccgctgcaaaagccaaagctgagaaggcaaaggctgatgccgctgcaaaagccaaagctgagaaggctaaagccgatgaaaaagcaaaggccgatgctgctgcaaaagcaaaagccaaagctgaggagaaggcaaaggctgatgcggagaaggctaaagccgatgccgctgcaaaagccaaagctgagaaggcaaaggctgacaaggctaaagaatcaaaagaactagagtcaaaggataaaactgaaacacatgaagatgtaccagatgagttggacgagtctggttatcatgaagatgaagagccaaccggtgtcgattacgaaaagagcaagcgtgcattcctaggtgattttgatagtggtagtggtgttggtactggcacaggtacgggtaagagtactggtggtgctaaggatgaggttgatgctaaagagaaaactgaatccaagccagaacccaaaccagaatccaaacctgaatctaaagcagaacccaaaccagaatccaaacctgaatctaaagcagagcccaaaccagaatccaaaccagaatccaaaacagacagcctagatgaactaatgcccgagtctgtcgatacatcgctagatatcgaagagatcgatgcctccagtcacacagttgatcgtagctttgtcgatgcactagacggtatggatcatgaaaaagccaagaagccgctaccgtcaatgagtaaggttgatgatggtaaagtaaagaaacgcaagcggtcaaaggagattgatgatgttgtagatgcaaagaagacaaaggagggtgaatcaaaagctagtggtaaactaatagttgatggtacactaaaagatgatgttgaaccaaaaactgatggtaaaccaaaagatgatgttgaatcaaaaactgatggtgaaccaaaagatgaggttaaatcaaaagaggacccaatggacaaagctgaaccaaaggacgctgctatagcaaaggagggtactaaaccaggtactcgtgcttaactatatacatgatttgattagatttactttgatttgactatacgactcttgttgtactatactcataatatgtaattgtatcatttaacaaaacttttgtattacatcttgtaactcttgtactaaaaaatatcttgtaataaaaacttgtaataaaaaatcttacaataaaaacttgtaattacttgtaataatacttgtaataaaaatcttgcactaaccaattccccaactaaatattgtaaactttatattgaattctgttctgatttttaatcatgtcaattttaaattacaggttctgcagacgagccggatggatactcgtacgacagtgaagaagatcttgagacgcacgtagtaataggtaacgttgacaaatcatctacttctgaaactgtagagccaaagggaacgttaggttttgtggacatgaaagaatctacagaagagggtacaagaaaatctgcaagtttcgatagcacgcataaaacattattatcgataaaagacattacagagctcaaggctgcgatgcacggcaaaaaaggcaccaaagagaactttgatgattctagtgaaattgttagcaaaaaagcaatgaagatgggtatagggtttggcgttgatgatgatggttatgagaatatgtcagactcggactctgagtctagtgtagaaacggttgctagtccacccagtattgaaaaggaggttattgaaaaggaggttgtggaaaaggttgttattgaaaaggatgttattgaaaaggaggttattgaaaaggaaaaggatggtattgaaaaggaggttgttgaagaaaaggatgttattgaaaaagaggttattgaaaaagagattattgaaaaggaggttgttgaagaaaaggatgttgttgaaaagagtagtatagcatcaagtattgaaactagtggtatatcatcaagtgttgaaactggtggtactataccaagcactgaaaaggcaacaaatccaccaaccattgaaaagacggttccagtaacggtgctagaccctacactagttatggaagtggatgaggatgacgatgactatttagaggctgaaccaatggatgtagatatcgagtccgagcctgaacccaagagcgaatcggttccaaaggatggttcggtagagacaatgaaggatagcactttagagccaaaagaggtaaaggttgtaaatccagttatagattcaaaggaaaagactgtagatgagaaatctgaaatacatgtagattcaactgtaggtaaatctgtagtggtgtcagagccaaaagtagttgatgtcaaggtagatgctaagggtgctcctaaattggatgataaatcggaggcaaaaactgaacctaaaaccgatgctaaaattaatacaaaatcaattgaccctaaagtagatggtagcgttgaaacaaaggccgagcccaaattagacaaagtggatgataaatctaaagatgaggttatgccagagagtaggccagagagtaggccagaacttaaaccagagagcaagtcggaagctaaaccagagagtaagccagaaattataccagagagcaagtcggaagctaaaccagagagtaagccagaaattataccagagagcaagtcggaagctaaaccagagagtaagccagaaattataccagagagcaagtcggaagctaaaccagaaagcaagacagaaactataccagagagtaagccagaaattataccagagagcaaggcagaaactaaaattgaccctaaagttgaatccaaagaatccaaacctaaagatgtccctaaagtagaactatccaaagctgaaaccaaggtagttgaaaaacctaaaactgatcctcctaaagatgatccagaaccaaaagtagaaattaaagaagttgaagttaaagtagtggaccctcctaaagccgaatctaaagtagtggtagaaactcctaaaactgtagagttgcccaaagttgaatctaaagtagtggtagaagcacctaaaacggtagaaccacctaaagctgaatctaaaacagtggatcctcctaaagcggaatctaaaacagtggaccctcccaaagctgaatctaaagtagtggtagaagcacctaaaacggtagaaccacctaaagctgaatctaaaacagtggaccctcctaaagttgaagttaaagtagtggatcctcaatctaaaacagtggatcctcctaaaactatagaaccacccaagactgtagaaacacccaaaattgtagagacacctacaattgtagaaacacccaaaattgtagaaacacccaatccttcaactcctcctgattttgatgaaccatctatggaatcgttcgacgaaccaatggatgttgacgaggaggaaatagctccggcattcaatccattcaatgtagttgacaaagagcacgaagaggttaaacgcaaagaggacgaagccaaacgtaaaaaggtcgagtctgaagttgaggtgcacaaagatcatgaaatgcattctagtgagtttgaacctccatccattgacgagtccgaggagaccgagactgacgagtacaaggctagtgcggctgcatttaagaatatgttcagcagcatggatgctggtgaaatgccagaatcgattcaacgcaaagatccaaaaattgtagatgttccaccaaagactccaccaactttaccaaaggttatagatgtacctcccaagactgtcgaacaacccaaacgtaaaaaagagccaaaacgcaaagaggaccctcccaagactatcgaacaacccaaacgtaaaaaagagtcaaagcgcaaagaggaacctccggtaattccaaaaactatcgaacaacctaaacgcaaagaggacccaataaaagaaacaccaaaggttgacgatggtgaagccaaacgtaaagccgatgctgaagcagcaaagcgaaaggctgatgctgaagcagccgaagccaaacgtaaagccgaggctgaagctgctgccaaacgcaaagcggaggctgaagctgctgccaaacgcaaagcggaggctgaagctgctgccaaacgcaaagcggaggctgaggcagccgaacgaaaaagaattgcagatgaaatagcagccgaagccaaacgcaaagccgatgcggacgccgctaaacgtaaagccgaggcagaagcagccaaactcaaagccgatgcggaagcagccgccaaacgaaaagcggaggctgaagcagccgaagccaaacgtaaagctgagattgaagcagccgccaaacgtaaagctgagattgaagcagccgccaaacgtaaagcggaggctgaagctgccgctaaacgcaaagcggaggctgaagctgctgctaaacgaaaagcggaggctgaagctgctgctaaacgaaaagcggaggctgaagctgctgaacgaaaaagaattgcagatgaactagccgccgctaaacgcaaagcggaggctgaagctgccgaagccaaacgtaaagccgatgctgaagcagcaaaacgaaaggccgatgctgaagccgccgctaaacgtaaagctgaggctgaggcagccaaacgaaaagcggaggctgaagctgccgaagccaaacgtaaagccgatgctgaagcagcaaaacgaaaggccgatgctgaagcagccgctaaacgtaaagcggaggctgaggcagccaaacgaaaagcggaggctgaagctgctgaacgaaaaagaattgcagatgaactagctgccgccaaacgtaaagccgaggctgaagcagccaaacgcaaagccgaggctgaagctgctgaacgaaaaagaattgcagatgaactagcagccgcgaaacgtaaagccgaggctgaagctgccgctaaacgcaaagcggaggctgaggcagccaaacgcaaagccgatgctgaagcagccgaacgaaaacgtattgcagaggaaaaacgtattagagaggaacaagcagccgctaaacgtaaagccgaggctgaagcagccgaacgaaaacgtattgcagaggaaaaacgtattgcagaggaaaaacgtatagcagaggaaaagcgtattagagatgaactagccgccgaagccaaacgcaaagccgacgaggaagcgaaacgtaaaatcgaatcaggtgaatttaaactccacagtcgaatctaataaacccataatggctctactttataaactgtttaactaatcataaaccttttctcttgtttcagaacccagcgaagagtacaacggaatggcagactttatggccgacctagaagattaaataagcacatcataataatgtaatgtaatgtaatgctaagcgcaaagtgtcgagtgtagataagaaagcaagtttatctaaaacgtattaaaagcaaagtgcaccgagtgtatcaaatgcaaaagttttactttgtaaatgtaaatgcctgtgcagttttaaactgtaccatagcgtacacacggtctaaaactgaacaagcataactttagacctaattaataattgcggataagaaacaatgtatgttgtgttttaattttataggttaatatgaaagaggttaagattttgattgtagaggttggttgcacattaggttaagtgcagtatattttacttgtaatatacttgctcgataatatgcatacttgcttgtatgtttgtactctatacttatgttgttagaaatagaatcagatttcattcatcaattccattagttgataattaaacaaaatttcattagttgctaatttaacaaaattccattagttgctaatttaacaaatgagaatattttcatcacaactttacaccaaatgtattttataaaaaataaatacttgtaaaaactacttgttttttagtcaaaaaaactacttgttttttaatcaaaaaactacacctacacctacacctacatctacaactctatccaaaattctaaacatctctagtctttggtatacaactgtttggtataggtatgtatactataatacaccatccacaacaccccacactacaacaacaaaggaaacagtgttgtgcaattgtgtgcaacaatgtaacaaatgttcaactcttaataaaaaccgacacaaagtattattctgattattacctcctccttctggccattttcataacctttcatcacggccaagtatcaatattctcaggtttgagtataaagcaatagcctattggtgttatttcaccggtcagtattgtagtttatgaaacatttttcttgtattttttaacaatggacttttgttgtgtaggtttataggattgatattgtgggtaggtattataaatggtttacagtatcgtgtgtgtgatttgtgtgatgtaaccttactacactactaataataatacttttgtaatgtgtgcgcatgcacgtactttttgcacaatagagaataaaactttatagtagatgaaccagggtgtaataaaatggtcaagagtattgttttaatatgggtgcatcatagattatgacattaggtaaagtgccgagtgtagaggtgtcggtaggtagtggtagacatttagcaagtatacgtgtgcatatataggtaacatttagtggctctacatgcaggcagcagctagccataaacctctagtccactttcaagaacttggactctaaaaacaaacattaaacacatggtttaatccacctttatgtgtgcatcaaggttgaattcaatttcaagcgagtgaattatttcacaccattcagtgaccagaaccgggcgagtacgggagttttgcagtgtgtgcaccaccctacatgtagtagtattatagtagttgtatgtatagcattacatacaaacttttgccactctgacttcagtctgacgcacactgtccactgtacatcattactggagatgtctagatacttgtacatttctagttttttagactggggttaaaaaagtcaaacagtgtataatagagtacctactgtttttatagtataaaccatgcttgttaatgaatctgtgcagtgaaaacaagagttacccaatatacatggacttgactttgtataaatacgcgtgtgtatatagtagtgttgctactttgaaaccaaaacaaacaaaacaacctacgctgtagtacacagtcataggatagataaacggacaagtataaaatacccgcgcacaacacctacaccaaccatagtgcttttgctgttgaccagtgtggactgtctggactgcaatacctactaatagtactacctattgtattattgtggtttttaaataaattaaaataaaattgaataaataaaatttaaatatactagacaaaaaaaatggaacccatggagtgcaagcccagtacctgcattgagagtggtgttggtggtgttggtggtggcgaagagtttacgacacctacgattactacaacggccgcgatcaatgctgttgactcggactctaacttaaacctaaatccaagcaacaacaacattaatgcaaccagccctactaatattactactacaacaccgtcgacaactgccacaactgctacaactatggccactaatgatactcctccaaccactgctaccgatgccgccaatgccactatacacaactcggcatcggcatcggcatcggcctctacatctgcttcatccatctctgcatccgtctccacctcggcatcggtatctgcatccacaaacgattgcaactcggccgacgagctaatgagtacgttgcgtcaaaaactcgtcagactcaaggagcgcgtctttaagaattgcaaatcaaaactaccgacctggaacaacaccgacgagactataaacatggtgcgatcgcaatcgtgcataaatcggtgcttctttaaactggccgaaatggatcaattgagcaactttagactgagcaacgatgccggcctgtttatggatctgtgcgctggaccaggtggttttaccgagtacctgacctacaagaattggtccaactttggcatcgtactacaacatcgagacttgccggtgcagattgagaagctacccaatccggcagccgtcaaggtgtacactgtggacctgttgaacgctcacgatcgcgatcgctttcgacacgatatgggcatcgtcaaagtggatctggtggtggccgatggatcgatcgattgccgtggccgtgaaaatctacaagagccgctcaactatgacctgatccgagcccaagtggacgtggcgtttgatcacatcaaggtgggtggtaattttgtattgaaaacgtttgatgcattcaccaatcagatgctcaatctgtactatgagatttactcgcactttgaagagtttaccgttgtcaaaccgaacacgtccaggccggccaatgccgaacgctatatcgtagccatgaactacaagggtgcaatcaaaaagagtcaacatgcacccttttataataacaatcacaataatcaacatcagaaatttgagagttacaagagtttccattacgagctagtagccaagctggcacagagacaaattagcgcattgcatgatttactgaaacagacaaagaatacccccttgtttgagaatggctacatgtttatgaagaacgccaaatgtacaaagactctgtttagcgtcactcccaaacttgtagacagtctaaagtgcatcaatactgtggatccggatttgttaaagtgtacacgacgagtgttggccgattcaaagagtgaccatatcggttttataaccacctcaaacgaaccgcacaaactgagagtcaaacttgccaaggacgatggaggcagacgacaccagtacgattacggtgcctcggcttttactggcactggtggtggtgctagttttgatgctggcattgacggtggtcgtcgtggtggtggtgcagtgtacaattgtgtgaggaatcaaaatcagttgagtttgaatcagagcctgtataagcaacaacaacaacatcacaatcaatatccatacagtaccaaaaacaatggtcattgtagtactggaggcaataataataacaacactgccaacaacaacagaggccaccgttatgccaatcgtcgcgctaaacagtttccgcacttttattactattttaacaaatctggagcaagagtgactgcggttcacgtgccaataaatcagttgaaaaatacacacaaggtccagtgtagagttgtacattcgatgcaagttttgagcgactatacagtatcgtttacacttccaccgggcgtggtcatgtttgctctgtttaacattgatcacaaaactaaacgtttatacaatgtaagactgttggacttgatgcaaacgtacaacgccaactatagcggtgactcgttgcaggtgcgcaaaaagattgttaaagagtttaaatacttatacagcatcggccagcaggatcctaacggaaactgcgatataaaccaacgggaaacagctggtgatgcaaattatcattacaacaccaattacaataatactactactaacaatgcccgagagtccaagtttgataccgatgtattattgaacggtagaggttcgtttaacatgtgcaccaagtacattaccgtgctcgatgcacgaggcggtgatttggtcgaggacgatctagagtttggtagcgagataaaccagcagcaagagcaacaacaacaacaaccacaaccacaacatgcaccatctggctatataccggtacactcggacactgtcgaaaccgatcccagcggtggtggttgtaccagtagtctgccttctctagacattcatccgatgccgtctagtgcaaagttgcacagagccagcaacgtaatgtgtctcgacaagagtgaagagtttgtcgactgtgccctcatcgatgacaagcccattgtgcagtatgcgcaacgcaaagactcgctctttgaagcacccatgaacttggacacggacgataccattatggacactatggaggaagaggtcgtagagagcggcggtcccagtacgggcagtagttttacgagcaccggtaccgtggccaccaatgtaatctatccgagcagtgtgagcgcagcctctacggcaaaggtgaaccagtctcatttgatgtacgattggtgtgataatgatttttcattttagttgaagagtttctacatttatactatagattaatctttattccatgtaaacatttttagctattggtcttgtgctttaatgttggctgtacaatatctagctattttgatgtataattacaacatctttcatgattgtataacatctatgattgtataacatctagtttgtaggtgactgtataacatctagttgacatcaagtttgcattttagtcataggtttgatttagagggttaatttagaggtttcatttagaggtttaatttagaggtgtaatttgcattaattagaatacctttgttttggattgtaatgccaaacttttgtgttgagatttattgtcctagttttgtattgtacttttagatgtttatttagatgtacggtgtcggtactattgtttagatgtattgtttagatgtatcatttagatgtagtgtttagatgtattgtttagatgtatcatttagatgcattgcacttgtaattataaggagagtaggagactaagtatggccacacaatgatctttaaatggtagcttagtttgtagtttaggttgtagactaggttggtagaatagatggtagagtagatggtagagtagatggtagagtaggatgttagagtaaaatataaagcatgtattagactgtaatactcatttaatcaaatataattatattacaattacatgtattcctaatgtattcataatgtactcctaatgtattcatgtattctcaaaattgtatctttgaaaaataaagcacctaattgagtacattcttgttttttagtcactataaaaatacctacccatgataaaagaccatatactaaaatacctaccaccctacctacctatctacctacctacacacactacacattgagattgtaagctcacctaattatagactctaaacaatagccaagtggtttcatttcaattttagttcacttcctcaataaacggcactacatcatagcagttcacagcaccacatttatacatggaaataaacttctactataggtagtaggtaggtacgcattggtagaaatacaaccacaagtataggaaccatacatgtgtacagacctaggcatttcctgtgatcttctccacattttacaccttcctctctatacccctcatttatatccatctatattaatttcaaatttattatcaaccagtaaccaatttagataatcctatttatatttgcatttatacactttaaccatttcccacatttatccatttcccatttataatcatatcctttggatgtttgttctacacacccgtgctcaggttcattatctgaaactcgtaaaatgagatcgtaaaaataaatacatagtgggtgcgattatttgcgcatgcttgttgtgcattttaaaattgaatgggatctgtactaggtgtagtgccatagagcgcgacagattagcaacagcagcagccagtgcacctagactctatatttgtgacacagagggattaatggttcgttaaaatcatacaatattatcaacgataaatactgcgctgctagtattaacggtgttcacagttatatatattggcagagttaatacctgatgtcgtatacgctgcttgtatactttaccgtgtggcggtcaagagttgtgcgtgtgcgactgattaaaaactcggtgcattattattctagtgtacagtgaataatagttaccatttatttgtacaattacaaactagaaactataaaatataaaatataaaatataaactataaactgtaaattataaattatcaactacttacaactaatactagacttatattttacacctacacaaattggtacacttgcaagatttacatacacaaactatgaaacacaaaaacagcaagaaattcaaaaatgctacaaatcactctaaaacatatcaacacaaaaagtacaagaataaaagatgtggtaccaatcagagtgtcacggtcatggaagatgcggtcaatgccaccgctcaacacaaagggtacaatttgagaaaattgcaatccaatacaaaacaatcaaccattgtggacggtcagtcaagtgaacagtttgccaataataattgtacaaaacagcaccagcaacaagagcaagaattcgacaccaggcatcggcaacacagggtgcgtagaaaaaggcatgcaaaggattctaccagttcaaagactagcagtgatattggtagtgacattggtagtgacattagtgatggtcctagtgtaatggatggtcctagtgtaatggtttcaaagtgtgtctcggattgtccagtaaagtgtggtaagattggtaatgattataatgctaatgctgctactactagtattgatacaagtaacatcagtactagtagcaatatcaatactagtagcagtatcagtgctagtaccagcatcagtactagcactactgctaccactacttttactaataacaacacaatttgtaaaactacaaacaccaataatattagtggcagtggcaattctctactcagaacatcattactgtatcccaagagattgttcaaacaacctacacttgtaactaaatatgctcctctagccaagcacccatcgttgccgttttgtctgcatctttacaatccacctactcatcctactagtacgcctactaccactattcatactgctactcctactactcatactactactactcaacatcatggcaatcctctaccttggacttgcaactattcaaattcaatatatcccaatcagtataatgtgaacaatcaacagtatcagaatcagacgcaaactcatactcatactcagcctcagactcatactcagactcagaatcaacaaccgtgtgtcaattgttacaagggtatttgttgtaatttaccaatacctcatcctccaacttgtacttgtaatcaaacctacaatcaaaactataaccatcaaaactacactcaaaactacaagcaagactacaatcaaaactataaccatcaaaactacactccatcatcctacaaccatcatcaaaattaccatcaaatgaagcatcctccaaattatacacattctacaagtaaccatccaagcaatcgcacaaacaataccaacaaaccaacctactactataccctagaacactttgcacacttgtgtgaacgcgtagccgcaaccgatcaaatgtcggaaaagattgaaatcgtcaaggtggtctttgactattgcgacgacgtaaagctatggtgccgcatgctattgccccagctcgaccccagagtgtacaatctcaagactagacagttggtaaaaatgtacgctcgcgtcttcaacagtctagtcaacaacagtaacaacaatagtaatggaatcgatttgacacgcttttactgtaattgcaaaagtaacgatgtcggtgctaaattgaatagattggaaatgttaagagtggaattgctacaaacgttaatgtttaaagacttggagagaaccggcgacgtggctcagactataatcagtttctttaacgaacaccattacaagtttcacagagagtgtaataaaccacacaagtgcaattttcttttgcaagaaactaatgacaagaatgcatctaaaccttacaacaacaatgaaagcgttaacgctgaggccttttatagaccccttgtacgtaaagaagaagagagacaaagaatcacgatgcctcaggttgacgagtttttaagcaacatggctgacagttcaatcactggcaaacacgcactattgtacgagataaccagacgatgcaactctatggaactaaaatatctaattcgtataatgaagcgcgacttgaaaataaacgccggctcaaagtgcatactggaagcgttgtcgcccaccgcatacttgatgtttcaactgtccaaagatttcaaactagtactggacctacagtgcggagaggataatgcgtcgacctttttagaagatccattctacgagtctggcagtaaaacaaacacaaatagaatcaacagacccattcaggacgttacggatgtgttacatgccaacaagtttgagaacccgtacaagctatactacaacacaactacaacaactacttttagacagtgtacgtgtacaaatatagctctgtacaatactatacctaatgtaattaataatggtaataatggtacctttcaatattcaaacgatgcaataaattcccatgatgtgactttgcataatttgcaattgcatcaatccaataatactaacaatatttctcaggacagtgtacagtttgaaaatgctagctgtgtgttgggtaatcatttaactggttcatcttttagtacaggaggcaatacttttagtgcaggtaatactatcagtacaggaggtaccactttcaatacaggccctataaacaattctctagaaccttggtctttggtagagtgtccatcaaacaatgtactaggagatgtggtgaactccgagtctttgtcgtttaataatgttgaatctttcaattgcatggaacctttgtctttcaatagtatggaacctttacctttcaacagtatggaatcgttacctctcaatagtgtggaatctttcaatagtatggaatctttaccttttactaatgtagagcccaccaacattatgaaccataacgtcgaccagtacagtgctatagactcgctatcattattcaatacttttaataatttagactttcaatttaataataatcaagcacttgatgtcgaccaagcttttgactctagccttaatcaatcatacaacaatcaagtctttaatgtaaatccaaaccagacctttaatacacctcaaacatcttttaatacaaatcatacacctcaaacatcctttagtgtaaatcaaccatttaatataaatccatcctttagcataaatccatcctttaatataaatcaatcattcaatacaaatcaaccgtcctttaatataaatcaaacctataccaacaacagtaacgaccaaccaacatctaataatattcaaactaccatatccgacaatgcacactcttcctataatgtcaactctaatttacaatcctataataccaaagagccatacatttatcataataataacaacaacaacaataactctcaatccaatgcatacaattccaataccagtgaattcaataacccggacaagtcactctttaacaacccatgcagtaacaacattactagtgctcccattgaaaacttgcaagtaccacagactattttagatttagatttccaagagtcgccgttcaacaccacctacaatacatgcaacacaacttttaacaatctaaacttcaatagtataccatacaatacggtaccatttaatcccttgcactctgacgacaaggccaattttgtgcacgtgcaaccgcaaaggagaccacccaaactacaagccaagcctaaccacaaagggtgtcgtaaatcttgcaaatgtaaaatgtgcaaggactcggtggatactgcaagtgtggtagattctataggtataacgagcggtggttgtggtgttggtggtggtagtagtagcattagcagtaaagtacaagattgtagagtgatggattgtagtataaattgtaacatggagtgtagtgtagagtgtagttttgaatctagtgttgatggtgatttacaacatgatgtaaactctactaccaacacaccatccagttccaacactggcactatcaacactatactcaatcacattagtgtagacactctgggtagtcggccagtaatctcactgaggcccatagactctttacgatgcactacaccaaagggcagtaaggccaactgtgttgacaattttgtgcaacctacatctacagtcacatccacgtccaagagtcggcctaggttgaatacaaagttgagcagtattggtatggcgagtgctagtccaagtgttgtaaatactactggtatgaatggtacaagtaagagtacaagtacaagtgcaagtaagagtacaagcacaagtacaagtataagtacaaatacaggtacaagtacaagcaccaaaggctctggagtcaatacacagattgactttgaagaatccctctaccgcagtgtaattgtacaaactcaaaaactcgatacactatccacaaataacactctaccaacgactctttataatcctataaattccagcactctatccttttccgagtactttaaaatgctagcaaagatgcatacaacagatgatgtaaacctcttggccagttccaataccagtgccagtgctgtaaatactagtctagtttcaaatacaacaagtttatgtataaccaaaagtacaaacacgagtacaaattcaagcataagcaaatgtacagattcaagtataaacaatagtacaagtatagacccatttcaaccagagacaaccaaacaaacctatatacgctattgttataaacctaaaaactctaataaagttgcacgcatacgagtaaatctatcttccaagttgaacctaaccatggacgaaccgatggccacagtggctccgatgttggctgcccagtgcaagtccatagaggtggcctttaaaaagtttcccaatggcatgatgtgcgagtacaagtacgacggtgaacgagtccagatacacaagagtcgctcagatttcaagtactattctcgctcactgaaatgcgtacccgaaaagaagctcggtgacctaacacaattgttgcaacgagccctgccctctgagtgcacctgcatcctagactgtgaactgctcatgatggacacggacactggcaaggttctaccgtttgacgccatcggtgtgcacaagcgtaaagcgttcaaaagcgccaaagtgtgcatcgtagtgtttgattgcatgtactttaacggacgctacctgtaccgagagcctctgtctgttcggcgagacattatcaaagacaacctaaccctgatcgagaatcgtatagttctctctgaacagaagcacatcacctcacccggtgaccttatggaagagtttaaacagtgcatgcgcttaaacatggagggcttgatgctcaagtgtgccaattcgtgctacatgcccggcaagcgtagatggctaaagatgaagcgcgactactttaagaatagcggagacactgccgacttggtcatcctaggcgcctggtacggtaccggtcgcctgggaggcctactctccgtctttctgatgggctgcttagatggcgattgcgtggaaccgacatgggtgggtttgacaaaggtgcacgccggcctcaacgatgtacaaatcaaacaactcaacgacatccttgaaccgttgatggtgcactcggccgcaatggatgtaccctggcgatttgtcaacgtcaaggattcacgcaaactgcccactatgattgcactcgatcccaagcagatgccggtactagaggtgttgtgcacagagttgacggccagcctatcctttaggtttccgcgtgtcattagaatcagaagcgacaaggactggaccggagtaacgtctctgcgctacattaaagagttggcctctggtgccggtaggttagagtgttgcaatgatcaaaagtctgtcgagatggaggatgctgaagatgtgtaggaggaggaggatagaggttgtaggaggataaatgttgtaagagtgtagagtgtacacgtttgaagaattagtttaagtcaccaatacttttatattgtactttagaatcatccttatttactttacaatttacaattgtactatactttacactttacactttattattataattttatatttatagtttatattttttgtaataacaagtttataaaaatgtgcattacaagtgtttaaaaaactagaacaattaccagtgtaaaaagtaagactatgaatacaatctagaattaaatgcaactttaaacacaaaagtaaatgcaaataacaagtattgttaaaccttaacattaacattaacccgtaaactttataaataaacgtgtgttgctaaatcagtctgtgtctcaatgtttcaactctaaaaccaatcctacctaaaccattaaacactctattagccgctatgcaacactactgctacattgatgcaaaatgcaacatgacattgtactccaaactcaatcacctcttctgaaaccctcttcgttcacagtgtctgcatagtagtcgagctcttcaatatcctcgtcttcatcatcatcatccgtacccttgtctttgctcttgtcattgtctttaccaacactgtcctttactgtaccatcaaccgaatctacagttttagatttactccctgattctttagagagctctggctctttagatggctcggactctatagagggttctgatttagacaattctttagatggctctgatttagacaattccttagagggtcctgatttagacaattccttagagggctctttagtggactcttccgtcttgctctccaaaacatccaaatctgcctttgaaccaaccgttgaatcaacctttgaatcactctttacaacctctacctcaacctttgaatccgactctttggcctctttgaccgtctttgtatcaaacagcctatcgtaccgagccatcaacagtcgcttgcacaaagtgtacaagtctctaaagctcaagttttcatccaaaacgttgccaacgttaaagattgatctgtagagtaccatcgagtttacagcatagccaaacacgatgagtgctaccaaaaaaactagagcgatgactagcaccgctcccagcgtgcacgacacaaattgagtaaacaccattttatcgttcaattcacaatactcgattagctgctttgcgataatacgctataggtcttatcgccgccaacaagtatagagacgcatgctttaattttttaaacaaaactaaccatgcaagagactgcggttgaaatgtgcatcaagcgtttgaaaaactcttcattcatcattgcacactatttcatacgcatacccagtttggatttggagattcatccgggtatgtatcaaaagggcaactttttgaatttaaactctaccaagcactatcgagtgttgacggtcacgtatgcgtgcagcgattgtctcaacgagctcctgatcaagagcgaaaacgtactgcacgcctggtactatccgttgatcaattgcgagactctgaccaagggattgtgcatcggtgcaccttggagcatccaaaccatactgtctacgtgtgcagctaccgtgatgggtatcctatttaccaagtatgaagcgtttacggccactctactgactctgtgcgtgctagtcatcatgattctgtgcatgcagtacaacgtccggcaagatgaagtctacaagtgcatacacgtttaaatcgtactattgtgcactacaataacctatatcggttgtgattgtaaatggtaatgattccttgacgcttctatgcatttgcattcaaaagtttaaaaatgagagtttctttatacttttacgattcccatcatcgaccaactcggccggatgcaccgtccaccgatgtgtacaccaaggtgctgtgtcgcgatccatcctcgaatctgggcactgtcggtgtccgtgtgggcaagaacgagctcgtactcggtgcgatagtgttcaagagcatcgccaacatggtgcccgacgtcaacatgtcctatctaatgtcggtgataatgtccacgctgcagggctgcggagaatctttgcaagacgtccagctgtacatttatcctccgactctgtttgagcaccatctcaactatacaaaccccaagaatcgattcatgtactataaaaactttgtaccgcaaacgttgggtgatcacgttagagtttcactaaaagtgtagattttagcataggcagtttctttagattaggacattatatttttttagatacaagcactgcaaacatggacgttgacgatgagcacaacttgatcgagactcgagtacgaaactgtcgcggcgatgacgacggtacttggacgatggaatcgttcatgaaccacatttccgaacccatcgtgtacaatgcggtaacgcagttggatcccaagcagtccaacaatgtaaatgttgcctacattcgcagtagaaatattttactatcgatgaagcacgctctgctgcagtacattgatttgttgaacaacacgtttgccatgatagacaccgcctcggtccagcccagagtgttgatcgagaaacgcaccaactatatgaaactcagacagttggccactcgtatgatgagtcgcatcaatttgcgtttgtgtaggctcaccgaacgctacaatgaaatcgaggagcaaacgcaaacgtttcagcgcaaggccaactctctcaagtcgtctttcaacaacgacaacacttctgtggaccgagtgcgtagactctttctcaccaccattgacagtaagaacaagattaaaccaatggtcgatgagtttaacgtggtggttgcagaggtgctcatggactatgacaattccaattcggaacagttggtggtcgagtctatggtgctgcctctcaagatcaatcctagctttatgaacgatttacagaatcgtttgaatgtcatcaacaagattgtccgagactatcagacgattcagttgaacaaatcaatcaagggcatgaacaagcctgtggagcagttgaacgtgctcattgataccttggataaagatgtaaaacgcaatgggggaggaaacggtggtgcaagtggaggtttcggtggaggcggtttcggtggatcaggcggcggtggaagcggaggcttcggaggcggtttcggaggctcaggaggaggtgccggaggtggcggcaatggaggcgacaccggatcaggaggctcgggaggtgtagatcccaatattgtagtagattttggaaacaatgtcaatctaaatggtaatgtagagtttaatacaaatgcaaatggtaatgtggaacctagcggtagtgtaggcggtgtaggcataggagtaggttcgggaaatctcaaaacatttatgccaactctgcagacgcagactgacgatgtcgatagatttctaatgaatcagagtgttcaatcaaacctacaagcaccaatcataccgatggatgtaaactttaacaatgcaaatgtcaacactgtaaatccagatgctttcaattctaatgtttttgatcaaaccaatgtcgaaatggttgaagctctaaacagacgcatggtacaagatgcagacatacagactcagatcaggatgcaaaaccagagcatcgactttgggaggccagagccagagccagcacccaagcctacacccaaacgtgtacgaaaacctagaaagagtcaaagcaaggtggtgcaaccgatcaaagtgatgcccggcacaccgatccaacaaatggtgcagtttgccgataccacaatcacaccgatacgcaatccagacgttgacatgcgtccgagtagatcgtctacaccaaacgaatcgttaataaagagcgagtctgaacttgatacgagcataaatattgtaatggaaccagaaccaatgattgaacccgagcctcaacaaaagacccctgtaccaatgagactaccggtcagtattcctttgccccccgagagattggtcgcgtttagtaaaaacattaacaacaatggaaatgtagatttgtttaagaatgctaacaataacaataatactagcaccaatacatccattgttagcaacgatacatccattgtcaaacaaactgtaagcaccgacttgtacgaaccgtcaaacgttaaagcaatcatgcagagcagtacaccagtggtgaaaaccaagggtgtcaccaaagccaaaaccagagccatgaagagtgtcaagcagcaggtgaaggctgtcaaacaaaagggcaccaccaaacagatgcacaccgtacaagaggagacaactcagcaaactgtacagactgacgacgatcaaatcatgcaagaaacggtccaacagacggtgcagcaaattaaaactgaaaccaaaacaccaacgaaacgacgaaggataacggctatgaaatcgcccagacagaaacgctacctgacgccagagtttgtcgagtcgagtgatgacagtgacgatgaggattcttccaagcccagtaccagcaacactactagtggtagtaatgctgccattacgcctcctaatacgattacaacacctaccacgagtgcaccacctatcaagagcacaactactaccaagagtgaaacgcctgttaagagtacaccaccacctaccaagagtacaactactagtaagagtacacctaccaagagcacaccaccacctactaagagtgcaactcctgctaagattacaacacctaccaagagtgcaactccaaataagagtacaactcctgttaagagtacacctcctaccaatactgttgttgaaactgatgccaataaggttactgacaacagcagcgccagcaacactagcagtaccagtgacactagcatgtctccaccaaagacgcccattgtgcacaaggccaaacgacaaaagcgcaaactcaacgatccctcaccggacgaggcgacgccaccaaagaaggcaccgcctctgttgccgcgcatcatacgaggtgtgacactgaatgcgcgcaacaactttatcgtcaatctgtacaacaacaactaccaactgtttgatcccagcggtgatggattcgaccctgttcaactgaacaaattcaaacagattagatccatgtttaagcaaatgtttaagaagcaaggtagatacaccaactacctactcaacaccaagattaaggataacatacaggcggtggtgaatcgattcctgggtgctgtacaagccacgataaaggagcctgctttagatagcataatagccacgctcgaagagtacgagtctatactgaatgatgacattaacgagtcgtacgaagatgaccgtcgagcgtatcgaaacaatgaacgtattgctgcactcttgcaacagtaccgcgagagtgatgaattcatcaaagccggcataataacgctaatcagtcaatcggagggtttcgaaggtcccgacgtggacgacatgctcaacaagtctagaagtgatacatcagagtcctttgccaaagtgtacgccaaagattatgccacgctagatagactatccaagggtacactggccaagttcccaaagcctagcgtggagccacccaaggatatgagcgtttcaacactggttccgatacactttatttaagagagagcgggtaattgttttaaagtgaagagtagttaatgtttgtataagtactttaatgtttgtgtactttaatattcaagtgtactttaaagtttcaaatgtactttaatgtctaagtgtactttaatgtttgtattttaatgtttgtactttaatgttgtagagagatgttatacatatatattttaatattaaaagtgttggttacatctatatattttgcataccagtattgccagtgttcatctagttttagagtataattttagagtataattttagagtatagacttagagtatagttgtagagttttaaaatctagagtttagtctacctatagagtcaccatcacatggtatgaaatcttgagagtatttataagagttgtaagagtatctaaaagatgaattgtaagaatatctaaaaggagtatctaaaagatgaattgtaagagcatctaaaagatggcttttatgcacaattggtaagaatgactacaaggataatgtttgtaatacaacttatttttttattaaaaaatataaataattaaatatatatttatactacaataccaagtattatttattattattcaaagtaaattaaagtaaaataataccacattttttatcctctacaatattacatccttggtatataaatctcaaccaaaggtgcacaaccgttaatacacaacactcggtcattcggtaggtacctacattgcccgcaaacacaacagcaacaacctcaactctccaaaatcaactcgttcaaatactcaaacattttgaccgattcaggtttggacagtgtgtatagtgaagtgtgatctccgggcatcactcgcaaagatgcaccattgttgtgcgcaaacgcctcactagagtctcggatgaaatcgtcagtgtttgtgagtacgtgtatacgatccgtgtagctcgctatggacaagggtaccggtgtcggtagatccttttcaacataaccaaccgacaagagtttgaacattagaaacttggttgtgctgctaccgtagaatccattgatgccaatgaatcgactaatgtacatgttgctactatcatgtttagtactgccgttgatgagtctaatcatgaggatggcgtaaaaggcacctgccgagtgtgccactataaagtactctttgggtggatcctttgcgtagagcgttggaatgtagttgacaatcaagtctctaatgtactcgacaatgtctcgagtttcggcatcgaatcgcacagggtgcgtaaacgttaccagtctacgtcggtgggtaaactcttggagggctctcagctcgggcgacatcattacaaacatgccaccgttcagatagatgattaccggtgagcccggttcgtagccagtgtcgttgtacgtgtacactttagagtctcggtactcgtgctcgacatactcggcgtctgatgcatcgctgtacaattgcgacggatagttgcgtatgataatgttggccaccaactgaggcttccacactagtaccgcaacgcacatgcacagtgttgtataaattataaaacttataacactgaaaatgctaatcatattgttgcaggattcaccgagtcccattaaagtataccggtatcaattcagcaccaatacgctataccgacaaaatctacaaaactaacaatgtcgtttctcttgaatatggaacgtaaacggctcaaggagctcgtatccagagactacaacatgctactggataattcgactcattacaaaaatgtctacattcacaccataggaatgagcctgagcgacaagcactatgagcagatactgtgcaatgattttccacgatccccgctcaagcactttacaatgtttacgagttccgagtacagcggtgcggtaccgttggtcattagcaaactggacggagtgtccgagacgtacaacgatgcccgaccctatctgtcggtgttttacacctttgcacccaaccagagcgagtactatagtttgaacattgagagcaaatacgatccactgtgcaacgacatgaagctgtggtactaccgagactttggaagcagactgattctgtttagagaaaacgtgcacgactacaaggagctcatcgctaccggcacatggaaactggccaatggcggtcacagttcaatgatgagcggatgcggtggtggtggcaatagcagtataagcaacaacaatggacactattacttgggatctagtcaggtaccaaaaaaggcaaaggatgccaggaccgagtctcaaacagagcctcaagcagagcctcggccagatttacaaacagacgttatggatgtagagaatcaacaacaggacaatgttcaaacagagacagatgtggaatccgactccaagcctaggtgtccgtttaatgcgatgccacacttgaacgatgtagtcaacgagtttaattacgattgtcaaaagtttataattttcatgagcatctcaaactgcaaagaagtgtacgatttcaagcacttgaaaaactttgccatcgactttggaggcaagattgtcattgatcaaaactatatcgaaacgtttgtaaatgctcctaggattacgtgaggtgtatacctagtgtgtttgattgtatgttttaatttaattgtatgttttaatttacaagtttaattttttgaataaagattcaagagtctaaaaaactacaagttgcatttatttatttcttaaacatttaaatacatacaagcacatactctacctacctacactaaacataacatttctcactctacatgagcctcctcttcaacatgaaatgagtacacactggatgcctagcgcatcgagtctgtttggtctgaagcatgcgttgacacactttacagtttttacactttatacaattgatgaccgagtcggatgaagagtccacttttgatttaccgagtccacttgaaatcttgccaggctttagttttttgctaccgtgcaacagcatcgccaccgaacgattgtactgattcaccgagtccaacacgtcctcggtacagtacctcgaacgagtcttgatggatttcttcaaatcgttgagtgggccagtttcgaaatcgatgcactccaacgatacagtgcacattttgaattgttcacactccgagtctagacagcaaaacgatggctccccaggtcccttgagtgagtacatgcgattcccgcactcggagcactttacgttttcgtatgcggtcaaccagatgcgcggacgatgcatcgattgcagcacaaatggtggagcatcgggatacactttgggcgattcaatctcattgatgggcaagtaccgagtgcgcaaccatgaactcatcgagtttggtacgagttcaacgactccaaaaatgatacgaatcgagtctttgatgtcggaccagactccttgctcgtcctcgtgagtcctatagattgcataggcaaacgctacaatttcacgattgtgaatcatgtcgatgagcgagtcctcggtgacggtcaactctccaaacttgtacgagtctatactgtaccatttagtcttgttggtaaagagccacattgttagactctttggtagaatgagttttaaaatgtcaatattcacgagcggtggctccgagtctttgttttcattgttttgctcagccttgaactcggactctgctaaacacgtttcgattccattggtgtcgacaacgatattatcgttggccttggttgccgagtccaaatctacaagagaatccacctcttcgcacacgagtttgggatcgtagactcggtcaacctgtacgagtatatcgtaatcgttcatcgaaatgaccttcatcttgaaaaatctctaaaaaaacacaagcatcaatagaccgagttcccagacgtaacataaacctttcggtccttgggaatcgtacgcttgcatctcacggatcgttgagttaaacacgaaatcataataacaataacagtcatgattccaacgattcccacaaagtagctatgcagcgcaactccgtacggaccgatcgtcttgtttataaactctaaatacagcgaatcgtgatccattccgagtgtgcatttatatataatttcaataagcaataaccccaataccgtattgatattaaaggcatgagttcttacatagaaatgagggattcggaagctttggatttgtgacaattctggctacgtgctcataggcacgtacatcctgaattgaccttggtagttttccattttgataagatttgattttcaaaattcctttgtctgaaacagtatataaagagacaaattttctggtcagttcagtctactttatacacccggaccaggaacaagcagccaaaggaccaacccagagcctcagagggagcccaggagtcacagatgagtactcttttgaatcacttgttgttttgatttgtatttgatggactctttgattgtgttttgactcgttacatttgtggggactcggtagaactcggtgtgaatcgttgactcggtgggggatcgttacatttgtggggactctttaactcagtgtgaatcgtaactcggtggggactcggtgggactcgttaactcggtgtgaatctgtaactcggtggggactctttaactcggtgtgaatcgtaacttgatgggactcgtttagttgactcttttgggtaaactcggtggggaatctttgtttagataaatgtaaagactcggtgggctcgttgggactctttgggactcgtggactctatgtaaactcggtggggctcttttgatagaatcggtggactcgtgtaatcgtaaactcgatggactcgtgtaattgtaaactcgatggactcgtgtaattgtaaactcgatggactcgtgtaattgtaaactcgatggactcgtgtaattgtaaactcgatggactcgtgtaattgtaaactcggtggactcgtgtaattgtaaactcggtggactcgtgtactcttaaactaatatggaatcgtttagtgtgactcggtggggctcgtgtactcttaaactatatggaatcgtttagtgggactcgtgtactcgtaaactcttttggaatcatttagtgtgactcggtggactcgtgtgctcttcgttaaaaaatcttaaactagagactcgggactcgttgtttccaaatcaaactaaaccaaacttgaactcgttcgtttaaacttaaactgagactcggtcaaggattcgggctttgatttaaattgtttaaactggatcatttagactcggtgtggctcggtataactaaatgggctctttgattcaaacttgaactcgggagttgaacttgaacctgcattgtaagctcggcggcgtgactaatctttataaaactctgtataatacgagtccaatattttgctttgcgctctacctactcttgtaacagttgacttctattgtgtatactatataatgctgcatattaaaactatatattaaactggctaatatttaataatttgcataatatttaacaagttacactactatttaataatttacacattaccactacttactaacaagagttgtacataccatttaaaattattgaaaggttactggggtacttaaaggttgctgggatattttaaaggcatcatccacaagactataactcaactttaacaactgtaaaatctttaaccgtagaatccaattgtttgatttaaggggtactgaaaagttgagactggtttaaaccggtataaattagacttgatttaaatttggctagctagtcttgatttaaatggggtcttgaatgaatgctcgtaaagttggactgattggactatgctaattggacacttgcatatagagacatagaggggttgcataaattttgtaatgatgcaaatctataggttgaagcgcattctgtgcaatgtctcaatctacaagagttgatgtgccggtaacgatacaatgcgatgagtgagtaggtagttgatcgacatcacttcttgcatgtagtacgacccttgtagtatccaattattgtatctatttggcttcttttctatacacttgcttctctatgctttgcacactgtactaaataaaatgtgcgtgtatctattgcttaaactaacatttgacttggacatttggaatacctacctaaatttagagtacagcgttgacattcaagtgaagtgtgaaatatacaagtggacagtgcgtgtgtgtgattattgttattgagtgcaaagtgtttatatattcaatttagattcagtgtttgcatattcgagtcagtgtacttttgatgtaaccttttgatttaaacttttgaattctaatatattctaaaatctaaaataattctaaaataattctaaacagtgaaacagtgcagtgaagtgtgaaatacaagtgaagtgtgaaatatacagtgaagtgtgaacaagtgttttgaatgaatgtacagtttgtcaagtatactgaagcgtcagagtaaatgattaaatgtaaatgtcaaataaatgcatcttaaatgcatctctcaggttgcactctgtaaccagggcggctcttgcaagttggcataagatcacaaatctctgccaccttcaatagtttgatcaaaggccggggctaggtactcggttgatggcattgtatggaagaatgtttgaacctaaaggattggctagtttaaagaatgatgtactagatgtgaatataatttatagtataaaagaaggatatttaaaaagaataacaccacctgatgtgcataaatttagagtagcgttaatcaggtttgtgaaatttatgcatttgtcaagtttactggaagagcgcctctataatttagaattatagttttatagaggctataaaatggtatgtgaaaattaaaaagcctgtgaaaaattaaatgcataaactgggagtgtgtatattaataacaaaagttatactgccataaactggaccacctagtaatgtaatgcacggaagtgggcatctattatacaactttacaagccaagagattctaaattggcacttgaagtatttgatagctttccagagttgaacaaggctgacggtaaagatgcctagattaaaccagcttgggcgtttaaaaataatttgctactaaaagtttaaactggcattaaattaaccaggcagtaaagtgggatacttggagtaaactgatggtaaaaccaactgacggtaaaactaaattgacattaaacagacactaatggtcttggctcttttagcggtagcatttatacatgtacatttcgtgtagtaagtatctagagtaatgtatgcatttacagacacatattgcttgttgacgggtaaattgctataatgggataaattgctataataacaccaagcctgctatcaaagaacattcatcataaacataaacatttaaccatgattaacaaccagccatcaacatggccaatatttacatcattaaccaacatttatacatcattaaccaacatttacatcattaagcgtgtccatctaataagccataacttggcaagtaaatgattgaaacattaattggcagttatacactaaacctcattctaaagctcaatctaaaacctcatttagcttgattgataaacattattcctagccgctttatagaccatcattaaacctcatttactgattataatcgcaaaccattaacattaacaatgttggctcttggaatctctttatatgcatagattgaatcgctttataaatacgtgcagcagtactttggttgggaatctttctgtacacttaatttgtgtgcttacagaaccatctagcggcatcggtcaaaacttgcacagagactggccgagtgcattttggtgtggtgaaggatgttttgagccgaggacaccttggatggtttactctgaggatgcttggattttggattttggatttggtaaagtatgggaggatgtatggtaagatggtttgttgtaaaatttatacaaaattacacaaggtgtgtatcgtttgattgtgttgaaatattctgatgggtagaatgtactaagattgcaattaaatgtgtttcaggagactgagcagacaactgcacctatatactctgccttaacctgacgagggttggtaagtaatggcaagtgttggattggtaagtaatggtaagtgtttgtaactgttggttttggtaagcattggtaagtattgtacagtgccaacttggtaagtgctggtaaatggtggtttggtaagtattggtaagtagtgtacagtggtgacttggtaagtattgtacaatggcaacttggtaagtatcatgtattggtaagtatcatgtattggtaagtattggcatctatcaggtatgcatacttgtagtttaactgttttgtaaaactgtttgaaataatgtgtgtctatatatctataaccatgtgtgccactaatcaatgcattctctttcaggtttaatcaaacttttatatgtttcagattcgagaactaataacaagtctctttgtttcagatgcactaatcaaaagtctctttgtttcagaatccttcatttgtaaagtattcaaatgaatttatacatgtattctgttatgtattctgttttaaactataagtattgtaaagcaaacaaaagtgtaaaacaacctactaaaaaaaccaaagcaatcaaccatccaagtgtaatgctattgtactgtttcaggcgcagaggacaaccctcgtccaaagtacagcatgctcaatttgcagctacaaggagcactctgtgagtatacaacctagacttgtaatataacagctaatgtaatttggtttcaatattgcaggtgctgtaattgacgcaaagtgatgtgtaaattgagcacggatattggactgctaccatacttggtgatttggtacgtataaaggtttagaggacttttaggttcaataaagagtttactacaacactaacaacaacaacaagtgttttactgtttcccatcctattgtcccgtgttgtttaaatttgattaaaccttttataggtgttctcggaagtcatcttgtcagaagtgggattctacatgattggattctaaaggattaaactctacaaggatttgaacgtgcctacaatgcagtacaagcaatcacttgaaatgtgcatcatacgctgtggaagtttaccaaagaattgaaaaataggaaatgaagaaaaaacaccccttcatctaggccattcgagataagaatacctgatatcgcacacctgaataaacaatccactgtgtggcataaacaaggctattgttttcgttttaatggccatattctaggaagtatattggttaccaagtgctgtcgtcgagtgtctagaaacgtgatatgcgctgttgccatggaaattgatgctgtggtggtgctactttggattggaatgtctaggcacaagcattgttcaagataacgattggtgtttgctgcaactacctaatgtatagtttaagtattgttaaatgatgaaatgataatgttgaaactatgttttaatacttgatatattggtatgttatgtttgagagtgattggcatgtttgagactgacgagtatatttgagaatgattggtatgactaaagatgattggtatgtctaaagatgattggtatgattgaagattggtatgactgaggattggtatgactaaagatgattggtatgaattttacggtgcctagctataagttgactgcaacgtttagatgtaagatgatttgcggtttctagttttaaggatgcgttttagattttaagaattgaatagttttaagatgcgtctagtctgtaagagtacggtctagttttaagtacacacgttagttttaagaatacggcctagttttaagtacacgtattagtttttaagaatgaatacacattctagttttatttctagttgtaagtctacacaccaaatcaagagtcctttgattctagatttgagattgaactgtattggttcaatataagcacagtacattacgctacactttacaaatcatcacaatcattacacaattcattgtacacaaattcatacattcatttacacaaaaacattcattacaccaaacattcattacacacaacattcattacacaaaatcatacattcatcacacaaaacattcattacacaaaacatcagtgtgtttggtttgtgcacactcttttttttgactactacctttgaatactacttgctactaacatctaatactaacctctactactaacctctactactaaccccaaagtgtctaacaatttaaatgttgcagagttacagtaaatgtctacacagaggcctacacagaagtctacatagaggtctacatcatagaggctacattctacagtctacctatggcatccaatattccaatggttgctgcatttacacaatatctggattggtttggtacagtatgcaactggtttgtagcacatcggtctctctagtatggtttgtataaatggtcaaatctagtttgtaagaataattacaatgctagaatacaagggtacccaaatcataatgcaaaaacatgtcttaatgttaaatgtttcagatgtgatccagcaaaactccaaagctaacccttgtgtgtttcagatgcagtcgttctccatcaaaccatcaaaccatcaaaccatcaacaacaagtgcacctatataaagtgcacggcaaacttgtgcaatcgtacaggttgccgttacaggtatttgcatgcttttgaattttacattcaacaatgcttttgggttcctaaacctgtttaaacttgatgtgtttgttaaagttggaatgtgtgtacgtataaaccggtatgttgaaccagtttgggttcggaatgtggagcccgtctagcgtgttctgatgctaccaatttgagatgaatgttaccaatttgagatgaatacaagggacgaatgtataaatgtataatgttggaattaattagaacttagactaagaatacttagactaagaatgtctattgaacatctactgtagtatatctactgtagtaatacatgtccgtatttgtatgtctgtatttgtatctatctgtaaatgtatctgtctgtaatttagtccaagtagaataagaaactatgaatacactctggattcaagaaagaagaacggtctcaatcggcatcggttacaaacgttgtttccatctatatgtatataacgaaactcggttataaacgttgtttctatattctatctataaagggactcggcatatgctactatgggaatcgtatggggactctaaatggtagactgaatgggtagcctgaatgggcagactgagactcatcatttgactgactaaatcaaacaacaactgactcttgacttgactcgacggtaccagactgtggtgccagactttcagacatcatctttccatactatttactcattcaaatcatctctctacatatatatattcaaattattctattcatcctctctctacatcaacattaaccttataatcatcaaccatacaattcacccctcgtagacctaagttttcatcacgtctacttttaaaataaaacacgggctctacttgtaatcaagtattaaacaattgtaatttagtattaaataatttagtattaaataatctctatatacatagtctacatttgaggttataaaacgttgtgtgcaaaattgaaaattgacactgttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaatttattatgcatgttaatttaagcgtttatttatagctttatacgttgaagatacattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgcattggatgcatcaaaagtgtaaaatttaaagagctagcggtaaaaatgataaaaagtatacaaatgtacacttttaggacaaaccagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctcggttcttatcgcaacagagtgggggccatccgcactataaaaagccgagactggtgacgaacaccatcagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacacgagacttgatggaacacttatatgtagaacaatactactagaggatagcatttagtagaggtgctgagaacaatagtgtgccgagtataatcataggtatgtgttgcaatactttttctttaatgcttttacattttacgattcattacttgacactgattgatattttatacttgttgatattgtgtggataatttatgagataatttatgaccatctgtgggaatctaagtaggtagggttttacacatgcttacacatacacactgacactgatacacattttacaaaccaaacaaaaacaaaacaaaagtacattaaaccaaacggaaaaccaataccatacattctatcattctatccttctactactattactaccactatctactatgggtacctaccaaacattttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggctcggttagttataaggctcggttagttataaggttcggttagctataagtcggtgcggctagtttatataagtccggttagatttaagtgcggctagtgtataagtcggtgtgagcacaaatcaatagatgtagtaagatgtgatactttatgaattgaactatagattgatacacggacggtaaacaagagttgatttgtgtagtatacgtcttcttcttcctacttcctactattataaataatataaaaaacatataaaataaaaacacgggttgtacacatttacacatacacactatacacaccaatttagggttacgataatttaggacatttaggataatgacaaagcgtctctggtaaagactggtggtaagactggcaaatactggtatataaatgcaaggatacaactaggtactgtactctgcaactattatactctggtatactcggcaaactttgtgtactctagtactctgataaagctatactctggtaaatactctggtagaattctgtactctgatatactctggtagactgtacatatacaactacaacaacaaatctggtaactcggtgactctgactctggcgtctattggtaactctggtggtattggtattggttaataaaggtaacaacggtttcaaacaaaggtattggtatcaaataacggcatcaaaggtattacacaaaggtattaaacaaaggtattaaacaaaaggtacaaacaatctgtttaggtaaatgcacacacacaagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgtgatgcgatcgttaggctctgtgtacgagtatcgcatcacacaaaaacccactgaccaaccccctcgcaccgtcacgttgtctttcaggcagtctctcgtggcgtgtgcgcttgtttgctttgcaaagagattgccttagtgccttgttgcaaccgtggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgacatttgttgtttcattttatacatcctgcatcctgatacaaccttttacacaaactgctgttaggtagagtgttttgttaggtagagtgttttaggtagactgtatgttatgtgttaggtttgatacaaacatataaatgtacaaatatataaaaccagagttaccactagggtttgagactataaagttgtgattgagtatagagttactctttgaagagtaggtaggtgttggtattctgaggagtattggtagtctacaagtatcctgccctgcaccgagcaccgagtcaacactgcactccgagttacactgcgctccgagtctgcatctacatctacaagctacgcacacgcatcctacccacctacatctacaagctacaagctacagctccgagcaccgagctccgagctccgagcaccgagtctcaccaaactaaacggtgcacgcaacctctactgtggtatcccagagagtgttggagtggtgcctttagttacctactataaaagagttgttagaactcagagtaacactataacccagagtagagctagaactcagagtaggtatacctagttaaacccaaagtagacagagtagaggcctagtatagataccagtatatgccagtctgtgtagctagcataggaggtaggtacctacggtaaaggtctggtttggtttggtaaagaggttacacctacacaccattttacattctcaaaaaacaagaatgtacaatggtataaaataatgtaaacttgcaatacaaagctaaacatgcaactattataaaactacaactacataccaaaccttctatcattccatctatcaatccatctatccacctacgccaccctagggcacctgcacaattgcactcaaactctgatgttgctcagacagtacgcgtaggttgtagagtctcaaaaagtcgtcaaatgtaaactctttggttgggtgaatcttgtgcaagttcaccttgttgtgcaggtcatagattcgagtaactggatcgccagtcagtagcataggataggtgattgccatgatgggctctagtttgtcatagttttcctgacacatgccgcacactagaatcagactgagattgatgagaatgctcgcaaaggccaccaggagctctttgtcgttctgagccagaatactggtcaggtgcagaaagcgccaatacgtgtgaccccaccactctttgagcttctcaatatcaaccggatacaggccatagtggtcgatgacaaacttgtaaaactcggcagcagtgtctgcatcctgcttgatgcgcacaaagtactcggacaccttgtcaccatcaatcttgggtcgcttcaacagtacactgagcatatcgaaaaagtctcgtttgtagtcgcacaccaccagattgtacaagtcggtgggaatcagatgcaccacataccagagcatcttggcggcagagactcgaacctcggaagtcaaccgttccggatccatgcacgcgtagatgcaaactctgtacgtgccctccaagcgcttcggtgtacgctccttgtacagcgccagtgttgaatcttcgtcgtcgttggccatgttggggaatctaaaaaactagagtggttgatggggttgatgggttgatgggggtgctgtattgtataatgtgtatttgatgattgatacttggtgctttgatacttgatatttgtaaaatgttgtttctaaaaaataaaaacacttgtgtgtgtctaaaaaatgagccttttatttattaatataaaacctttacatgtactttaagatactacaagatacgactacaagatactctaaggtactccaagatattctaaaatactctaaatatttgatatacaatacacacgtgtataaatacaggtacactacctacttaaatctaatggcaatacacatggtggttacaaacaactgccaagtaaattgtaggataggtagtaaattgtaggatacatttattctgaattcataccaacaccagccctaaacagactaacttctgaaccatagtcagagtcggaagccaacgaactctgcgtagactcggaagtgatgctcgaacacgaactgcacaaacgacgacgacgcagtcttgaactagagcgcagcttggcacggtaatcattctttgggttgcttatgctggtgggtgcacttgcaggcggtaggacgacatccaccatgtcttgtcctgtaggtgtggtagtaggtggcggcggaggtgtaggactacggctatcggcacaaccaccatctacactgttagacttgacgattccatcattggcactactactagacagtttacgataggcagcctcttcggtatagtctcggttaaagagtttgtttacgcgacgcaggcaacgattcgagatgccaccggttgttgttggtgttggtgttgccggttctacgctcttgcgcttagtgggcctaatcttgcacttggccatgtagcgttcctcgacacgcttcaagtcggccatcaactgttcggcaaagcgtctctcaaactcttgaatatcttcgacgccaaactctcgtcggatctcttcgtcaatcattctaagtttggcgtcttgcaactcggcctccttttgcaattgcaactcttgcagttcggcctcttgcctattgagctcctttaggcggtgctgttgtgccagctcgtgcatcggcctagtgccgcattcatcgaatccctctacgcatatgggatcgtgttcaaacgaatagctactgcggctacgcaccagattggacacggccgctatgggtctcttgaagagtcccatcagtgcactcaacaggttgttgtttgagcgattcatagtgtacaagagcaagttgaaaatttacaatctgtaggtacaaggtatacagtacaaggtatacaatacaaggtatacaatacaagatacaatacaagatgcaatacaagtattggtatcttgcaagcctctatagtattattagcagtggaagtagcctatatatatttattaaagctttaggtaatactagtagcctctgtgaatagtgcaacggtccaagtacaaataccatattgcggtaaagctgcaccagttttataccatgttgtggagaaaatgtagtaataaatgttacactttgaagggattaatccggtccgttatccactgccacacattaaaggcaatgttggcgtacgatacgctgactagtgcaacgctcagcaggagcatcaagactccgagcaggtagactcgtaaaactatcaacacgacaccgataccgacagcgatgcccgtgtaccgatttatagtgtcaaaggcctgtctgcgtagcttgtgatgagactcgtacacttcaaagtcttgcaccgtaaacagtttggctcgcgttagaatcttttcaaactctatcgagcccacatcgatcacgttgcccttgttgattcgagctccgtccgagttgacttctagggcgtccaagtagcgatacgtgtacgtgtacgattctatgctggcatcgaacaaatcctcctcggtcaataggaacgagcacacgtagtcgaacgtcagcaccggtcgattggtcttgagctgagagcgcaacgccatctttgagttttcgtacaactggtgcaggtagtcgggcgtgtacatgttgttgaaacccaacggatcccagaacgtgagcagtatgctaaagagttgcgttatcagcaagactacacccacaccggtcgaggccatggccagactcttggtcaggtagacgccgatcgtgcccagactgcgcaccgtcaacggtaccaccaagtctcgtacggccactttgaacgatgcacccaacactagttccgaggtgtcgatggccatcgtggcgaccttcttttgtagcaacggcaccagtttttgaatcgccttcaccgtcatcgtctttagttgactggccagttgagtgacgcccacgtctacagcaacgctggcggcaaagtctgcgctggtcagttcgttgagcagcgacagtatgatcgattcaaacttggtctgtttgccagtctgcgaggctagggcatttttgagttcacgatccgcacccgatgtatcgttgaggctcttgactagatttaagagtttttcaatgtcttgatttttggtagtactagagctagtactaggcttggtaggctttggtttagatttcatcatagcatcatccactcggacaattttaacattgtcagccattggtatagtgttgggactcctcttgcttctgtgattcactcggttcattgtttccaaatcgctcacggtcacatctatgggcggtagtttaaaattgggatcgacgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgctagtctctgaccaacggtagcgaacgttgtgtggcttgtcggtaccgtcatcggtgtgcacggccgtttcgaacaagtggaagcaggccggattgcattgaacctcaaagttttcactctcgcccaatctatagtagctggccgcatccgtctttttgcagggtccgtgcacaccggacgagttgcacgaaatgctctcgcacaattgttttgtaatctctgcctctacaaatatggcctcggaggccattgccggtggaatgtaataatctgcatcggtggccgctctgacgttgactttcaagtgcgacgccaagaagggatacttttcgttgagcttgtgcagtagcatcaagagtttacgatggtacgaaaacttggaggcatttgcaatgtctagttgggtgtaggttgtggtggtagtggtaggattaggattagggttattaggtacagtagacattgttggttgtgtggattcattaacctagcatatacatacacgcaaacgtgatatttatacaaagagttatacctaatatttattaagtactcgataagtacaaagattcaagtacctagtactactatggggaatgtgcacacacagactctctcttccttttgatggaatttaaactttttgtacaataaaattaacaagcaagattaatatgcaaatagcaataacgtgcaggttaatatgcaaattttaatgaggagttcaacttatgagacttttatgacaatatcaagttttgtaaataaaaggttattttcaactgcaacaatgtgtgatgcaaatttgagtttgtacagagtagctctattaaaaaagaatactgcaagtgttgttcattttatacacaacttgtcatatacgagtactagtgacactactagtgctacaactagtaccactactactaatacaactagtacaactagtacaactagcacctactacaacccatcatagaggtttaccaattcttgtaatcttgtaatcttgtaatataaactaaaactaaatattcttacattaccaattctctttacaataccaatcatcattatacaataccaattcttacaataccaatcatcattatacaataccaattcttacaataccaatcatccttacaattattacaactgccaattatagctctatgtagctctaccaccagctactacagtctacactctacacactccggcactctacatgatccagtacatgctccattctacacactctggcactcggcacactactcactctactctacatactcttatcctaatactcttacaaatatttaaacaacaaataacaagcaatagcaacaacataggcggactttaagactttactgtaaactaggatgttcagactaatttgataaactaggactttaagacttcttcaaactctttgactattttaacttctttaacctttaaaactatagctcaaattgatacattataataaaagtacaataaaagtacaacaaaagtacaataaaagtataataaaagcacaacaacccactacctcccttcaaacatcaaatcccttggatctttacaagtactttaaatttccaaacattttagatccatgattaaagtacaagtctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagtcgcaaccgcttcaagtgcccgattacgtgaccgggatctccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtatagcttgataatgtgagagatgagcgcttcgctagtgggaaactcttcgccgtttacatagtctacgtacaagttttgctgaatcaggtagtcgacgttttcaaagtagactagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgccggttagtacatgttcaaacgactgggaccgcctccggtgggcgcctcggtacgcatgggcacaatatccagaaagggtggcagcttgagattttgagccaaggcttcgcgattcatgaccgtctgcaaattgaccagattcgatacgataccgttcagagtgctgtgcggtagcatctgcaccgaggcactcctcggcgtatattgaaactggtaaacgtttgcgttggccaacatgtttacctgttcggtggacttgcgcactagatcgttaaagacggtaacgtaggcgccctcctcgggcttgtacgaactctttacgttgaccctgcacgttgtgggattcatagtgttggtgatgggctgctccactttgctccggagccagaaaaagatgctattcttaaagtgggcaaagtttttgttcttgtacgcactgaccgcctttaggtactcgcacagtatactctgcaggtgaacgtattgctcgtcaccgggcgtactgttggcaaagctctcaaaggcgggcagtgtcatgatttttgaaaaacacttggcaaactcgccgacggtaaaggttcgcttcgtaccgatggtggtgacggcgtccactacatcgggactcatgtagttgcgattggccttgtaaatgtttttcaacgtctcgggatcggcgacgccactctttataaactcttcaaagagttgcttggtgcgatcctgttcctcaaacatgattgcgatacactttgtatacgatcggtgtacatagcatctacactattatgcaaatttcctgatagatgcaatagtctattgatcatcagatggtcggaaactttgacaaggagctatcggtgcacaatgcgcaaatatattcacctgttgcagagcaacaaaaacagtaaagtgtacagcgtcgaagacttggacggtacactttacgtgatgaagattataaaaaatcccagtacactggtagagattgaggtgccctacaaactcaagcgtctaacgccctgggtcatggtaccgtaccgggtaaactttaaaaaggacaaactagtcatctactctagctatatggagaacaaggacctgactcacaatgtgacatcgatgagttgccagtccaagctgagggcgctactcaatgtggccgaagtgattcagtgtatgcactccaaattaaagtgtatgcacaacgacattaagcctgaaaacattttcatcgatcgctacaagaatgccaagctgggcgactttggcctgtgtcggtacaaggtacaaaactgcaccgctctaatgggcacatcccgatacatgtcccccgagaagttgtcgtcttcgtacgattaccgttcagatatatggtcatttggagtgactgcttattactgttttacgaacggggccctaccgtttcgcatatcggacaattgtgaggatgctcgcaaagtcaactggaccatgcatacggaccctctgaaggtggtctttgatcaagatttacgagaattgatagtcgagatgttgacgtacgacattagccggaggttgaccaatttgagtgagattatagagaggttaaagatggtttataaaaagtttgaaaattatgttagttagagggggggggtgtagagggtagctgtggatgtaggtagatgtagacgtagacgtagactcggcagcgagatttggttgtattagttgcatttatgcatggtatttattaaaaactagcaagtattaaaagtattgtaaaaattatagatcatgggtatttgtagtgtgtacttgtactcttgtgtatatgttgtatatatatagtttgtatacattttgtatatattttgcatcaacctagttgtacaattgtcattacctattttttagacaccccataaatgtcaaaccttgtactctttaaactcttcaaaggttcccctctaaagctaaacaaacccaagatgctaaccatcaatataacgtatccaccgaggcccaaggttccgataaacctcatcgtggccgtgtgtgaaaacaacatgggcatcggtatgaacaacgcactgccctggcacttgaagcgtgaaatggcacactttaccaagaccaccacgacagcaacgcaccccaacaagaacgcagtcataatgggccgattgacttgggagagtataccgaaacgattcaggccgctacccggtcgggtaaacattgtgctgaccaccaagcaccgaggcgactacgatggagccacgcgagtgtcaaactttgacgaagccatcagagtcgtcgagtctcgtggtgacattgagaccgcctgggtaattggaggagcgtccgtgtacgcagcggcaatgacccatcccaattgtcaccaaatacacttgactgcgatcaaaaagtattacgagtgcaacgtctttttccccaagattgatacgactcgattcgagctaatctctgaaacgccgtgtacgcgcgaaggcgacgttcaatattcctacaaagtttatcaacaacgaaacacacacgcttccatctaatatgtgcgtgccgcgataacgtcaatacgctattgttgttatatgtgagcagtagtattgtagttcaacgctttttgtgcaagtttcaagtttcttttagatgcctcgaactttgttgcattctgaagtggacgcagtcagttggtgtattgttgaatatgaaattgtggaatatgagatttatgaaattgttgaatacgagattgtttgaaagtaggtttagtttccaagtttaggattcagagcaccctttgtgtatctattataatatatatatgtataagtatacaattgttgttaatcattctttataggatgaaaaggtgtattgtgtatagtagtactaggtagtaggcaatggggtagtgtgttgtaaaataaattgcttagaataaattactaggaactgcaattaggtgcaattagaatatgagggtttaatttaatttagttttttaaagaaatcatcacttgtgttgattgtcataaatggcaaccacacacacactcttggaaaaaagagggtgcacttgcagatcgtaaaagttgcaataaatttcatcaacctaatcccttgcacatgtagtagggtgctcttttatggtaatatgcaaaacacatgggatctaggtttgatgcgttgacatttattacaacagtcagatcgtaaaagttgcaataaatttcatcaacctaatcccttgcacatgtagtagggtgctcttttatggtaatatgcaaaacacatgggatctaggtttgatgcgttgacatttattacaacagtctgagatccttgaaaatccaatacaaaaaagtatcgtaaattatcgatggcgtgtgacgtaacctcttgcgggttttatagcttttctcgaaactctgtcccgagactgggtttatggtttttgtgtggttttttgtgagctacatgtatagctgggtacagctcactcttctggatgtcataaaacttaaagtttacgatgcccactttatatttattgcaaaaaacttggtattgtaggaaacaaggacaccgataagggaaagatgcaggttgccatcgtaaagacttatcatggaaatcaaattgtttccaccggtataattgtgcttttatttaatacacgctagacaaaggatgttttaaaattagtttttaaaagaatcaaaggaaaagttgcaaagttgtacacaaagcgcatcctcaaactgccaacagcatctaccacccatagtctagatttttaattgggtttcgtaactattataaaaacgctttgtgtaatgtaaaagtgtccgagtcagagtgctaggaacctttaagagaggagagaaactcaatttacagtaaaatgcagtttagcactagaatggcctgaaacgctatgctacagttttcaaaacacacgcacacacatcaaaagactttgtagtgtgagagaaatgaaaaaaaccataccagccagggcagcatgtatataaacggagcagtcttatcgcatggtttcagttaggcgcgttcttttgatcgataaatgtcagattttagtttagttatggtttttgactgaaaacatatagactgattgtattatgccatggtttatcaacagatgttagtactagtaggtaccagtatattggtaatcaaaatatttcatacacgtgtaaggctctagcaacaacaataacaaagggcagataaggggttgccacaatacgcatgataggaaatgcatagattagtcacggaagttcctctgtacgtgcaacaacaaagtggtgcattactgtaattagcgataattatggtaaccacaattatgaaactacaatgcattgattcataatacaccccttatcaccagtggtgtagattatattgtattataaattagttcatgactaggttagtcgcttcagtcaatcgcaaagcttcttatggtcaacttccggcgtagggtttgtgtgctcctgtttgtgcgagtattcagttgagctcctccctctctgctaatgtgacaagtgctctctctcttggacagtgtgtgtgtttatttacaaacaatgaaaaactctatagtttaatgacttgattttcgattcgtgcatcaaaggtgtactattagtttcaaaggtgtacacaaaaaaatagtgtaaaacaatggtgtgctacgcggacacaatggactctaccgatgcgtttgatgcaccctctccggtgcagaaagagtttagcctggtcgaatacattctcgatgaggccgaggaacgtcgccgactcaatcgagagtgtcgaagctatcgtgaattcaaacgtaggctaaagaatttgaaacatcagcgcgaagccagacgtcaaagctttgactcttcgcgcgattctacaaccaacgttagtatcgttaccaatacgagtacttctacggctgctaatgatgatgatgatactgttgctacggctactactgctacacatggtgatatcgaggctgctagaaatgtggctgctacaacaacaacaacaacaacaaaatcaaaatcaagaccaaagtcaagatcaagatcaaaatcaataccaataccaatgccgacaccaatgccaacaactgcaaatgcaattgctacaactgtaaatgcaacttcaactttaacttcaacttcaacaacaacaaacggactccttaaacccctcaagattaagacgaagcgatcccacattgaagactcggatactgacgatgccgactacgcaccaccagtcaattacggtaaacgtcgacgagtctctatgtctagtatgcctagtgtgcctagtgtgcctagtgtgccttctaatgccaatactaacagtaacagcaacaacaacaatagtagtattagtatttacaatggtgttaaaagtaatgctaaaagtaatggcactaatgtcaactctgtgcatccaccacccactaccactcttgctaacccttgtaaaattcaagcacccaccaagaatctggacaagattcgcgaacagcgcaaacacgatagataccgtaagcgtgatcgcaaacgcaaagccgagcccattgtagactttgatggggctgtcaataaattgatcaagagtgaactcaatgttgatgtggaggtgatgccaccgcccagtattaaaccgcgcaggaaaaaggccaaggctacgtgcaagtattgtcgaaaggtaatctctaaccgttccaatctgctgcgacacgtaagggatgtgcacaagaaggacactagccggtacgatagtcagtgttcctctagcgcagaggatttgattcagagcgataataacaacaatttcagcagcaacctaaagagggctatgcttcatggaaagcccaagaaaccggcagctgttgagaatatagtcatagagtgcacaccctttgacgatggcatgatgtacaaacactttatggcagattcggacgacttggaggatgatgagggtgtggtagagaaggagcccgactattataatgtcaaaactccagatttgtttcacgatgaaaagatgaacattccaaagctgactagtgctcaaatacacggacccagaggcaacggtgtagacaatggtatagtctacataaaggccgattcctatgccgccagtattaacttgttcaactgtcagggtattaaacgtaaggataagggtactagtgttaagaatactgcaagtaaggatactacaagtaaggatattacaagtaaggatattacaagtaaggctgttacaaataagtctattacaaataaggatacaattaaggatataaacaagactaatgatgccagtataactaaaagtacaaatgtaaacaatagtgtaaatagttcaagtttaaatgaagaggacgaatcgcatcaatcgatgcctgaatattcaaaccctgaatattcacaacctgaatattcaaaccatttaaatgataatgtaaatgaagatgtacatgtaaatgaagatgtacatgtaaatgaagatgtaaataagagtgtaaatataggtgaagagtgtaatgataatggaaatgagcaaagtgatgtggagcaggtcgacgaactggatgcaatcaataatgtagacggtggtgcggaatctaatgtagagatggattccaatgtagagatggattccaatgcagagatggaatctaatgtagatgaggttgaacaggaaaattcacaagagtcgttacaagaggaggtaacgcaagacgagtctcaaactgaggccaacgaggatgatcaatctcagaacgaggaacatgacacaattgatgatgaacagccagaggatcaacaagaatgcaccgaggaacaagaacatactgaggaccaacaagaatgcaccgaggagcaacaagaacactctgaggccgagcccgaagaaggctccgactccgagtctgaatctggctccgaatctggttcgggttctagttcaagctctgactccgacactgaatcaaactcggacgccgaatccaacgctgaatcggaggatgaggacaatgcatccgaacaaccggctgaaaccaaagtagaggttagtggtgtggacagagtcaatgatgataccgaagagtgtgttgttgttgtagagagtgtacagccagaggaggtggccatacaggagattgctgaaattgaattacccaatctagaattggaacatgaattggatgactttccagagccagagggtgctctgagttccgacgacttggaaccgaaacgtgtagacttgcagtgtgagattgacgagctaatgaacgaccacgtggcattttccaaagattccacaatagaggcctttaacaaaattgatgaattgttatcgacaattcaaccattaccaatgagtacaatggaaccattagctgacgatgatgttaatgaggatttaaacagtcttgcaaataccatttctaatgcattaatccctaatgggtgcaatgtaatctccaatggaatgcagccccttgttgactcaggttggtatttgcacttttgtgtttactacacgctctctctctacactatactgcacactatactgctacaactacctgatttactacctgatccactacctgatctatacctgatctatacactacacacgcatacatttataaatacatgtacaactttacaataccagacggaatctacactacactactgaatctatacttctacactgctacactgtaccacttttacacccacctataacatttacttgtacgtacctataaccccatttacttgtataaatctcatctcgtttttagactgtgcattttgtgtacctacatacgtgatcctacattgaaaatgtcctacattgaaaatgtcctacattaaactgtgtctaccattgtatgtgtatgtaacctaaaactgtactcatcaccctccattctcatccatttcagattgtaaaaacatcactggtgcgggcaacggctacaactatattgtgcatccccataacaccaacaatctcatcagcaaccccatcatcagcagtgtcaataatccatcgaccatcatatcctccttcggaatgaaatcatctgaaagcgtgccaatcaactctgcgggtgactctatcaatctgtatacacttgcatgcgtagcggataatgttcagtacaatagtaataccaataataatagtagtagtagcactagcaacatcaatggtgcatctttgcctccgtgcggtaccctaagacgcgctcaggatactgcaaccagtgtcttgatatttgattgtaagaatgtaacttttgaaccgagcaacaataccttttatccaaccggtcccaatctgttgaccaatactgaatctgagcttgagctagaggaagagtctagcgtatcgggtattgccgacttttcaatgtacattcgcgatatgcaaaacgatgacccgctcttgtcaccgatgctgtcctccaacggttcagagaaacagctagagcaagacttgatggtgaccacgaccactgtggatgacttgaatggtaactgtaatttgactgacaactcgactggcaacaactttgaagatgctccaatggacattgatgggacaagtgtaggtgctttacagactactctagagacggtagaaacattacagacagaaccattacagaccaatactgtagaaccattacagacggcgactgttgcaaagatggacgagattgagactgtaggtaacgatactgttgtagatgtaggcaatgattcaatacctgcaaacatacccgaacccaatcatcctaatcctttacccgaagctggtgtcagtgttgaaactaacagcggtggtaatggtacggtgtctactaataaaactaatgatactaacagtactaatactaacaatactaacagtactaatactaacaatactaacaacactactaccaatactactactaacactactaacagtaatgatattgaggggactaacaccaacattgatgccaattctactacaactaatgcaaacaccaacaaccacaacaacaccaacaacaccaaaccctcctcccccatccatcgcagtgtattgaatcaattcaaaaaagtcattgaacacaactcgggctggtccaatctggacgagctactgttcatggccgactatatagagcccacgtccaaagtgtacatgatgtacaattttaaaaagcttacaactctacaagattcggtatcggacattgaaaccttgatacgcaccgaagtcaaacagtccatctcaaagaccaccctggactatttgaccgcggtggtcgtgcactatattcaaacatttgcagcctctatgattatgtgcaatctgagaatgggtaggaagacggtgtcgagtgcatcctattgcaattttgccgagtacactcgcgacttgacgatgagtactcaagagatgcttctattggaattgtccacgtccggtgtgctgctaaacttgccaactgtagaatctataatcttgaagggttttatgcatgcgttgcctcatcaacacttggacgcgaacagtatcgaacacgaaactggtattctaaagatgctctacaacattgacttgactgacgagtttttacaagttattcgttcctacgccattaaactgatcaagtctatgggctttatgctcaagcgcgaaaacttgacgcagatagatttgtgtcaattgagtgacaccctaaagcgacactctaacgtgttcaagctcagatcatttctcaactttgatatgcatcctagtttgtgaattttaccattaaactttgtgtactttgaaatgtgattttgtgaaatgtagaatgtgattttgtataacttgtaatgtgattttatgaaaagacttgccaaaattgtaaattgagatttacattttcaaaaagtgtaaatgtcgatatcg

SEQ ID NO: 21 - protein, 1028 aa, Heliothis virescens nudivirus
MYSSHSILFNSTLYTNKLALALNLLTFTLLDLILTKLMNISCMFIDGDDSGKDKAGDTDKAGDTGKSVEGKNKTLEIMNQTIETKNKTVEGKNKTVEEKSKSKPAEDKTKPAEDKDKGTDKGKGKGKTTEDEVESDEDIDTDVDTDSDEDEYTDHDERNNSAKAFLGAFAEYDEAAAKAAEEKRKKAKELELADVPKVKDGEGSKAKDEAKAKDEAKAKDEAKAKDEAKAKDEAKAKDEAKAKDEAKAKDESKAKATPKSTEKPKAKDESKAKATPKSTEKPKAKDESKAKATPKSTEEPKAKDESKAKAPPKSTDEAKAKATPKSTADPKAKETPKSTDEAKAKEPPKSKDGSIPSSLVPDFESEPDYESDEDESSEHEITSTTLLNAFNKLDEESRKESAGSTGTSSTGVGSSGSGTGSSTGGGGKFAKPTPDSSTPGKDKREVVRIDTVGDAGSKSGTKHAVVKSGIGSSGKGSGTGSGTPKVAVADSSVEDEMSEGEEDIDEFDETSAAEAEKARKVLLELEKGSVAGGKAKSSDVGDAKVDDKGKESKSLGKTEDKGIKVDDKGSKAEDKGTKAEDKGVKVDNKEEPKVDDKIDDESDDSGMDIDESDETSEEEAERNRKLLMSTFESLDKEKPEKVKVDDKAKTDEKAKADAAAKAKAEEKAKADAAAKAKADEKAKAEEKAKADAAAKAKAEKAKADAAAKAKAEKAKADEKAKADAAAKAKAKAEEKAKADAEKAKADAAAKAKAEKAKADKAKESKELESKDKTETHEDVPDELDESGYHEDEEPTGVDYEKSKRAFLGDFDSGSGVGTGTGTGKSTGGAKDEVDAKEKTESKPEPKPESKPESKAEPKPESKPESKAEPKPESKPESKTDSLDELMPESVDTSLDIEEIDASSHTVDRSFVDALDGMDHEKAKKPLPSMSKVDDGKVKKRKRSKEIDDVVDAKKTKEGESKASGKLIVDGTLKDDVEPKTDGKPKDDVESKTDGEPKDEVKSKEDPMDKAEPKDAAIAKEGTKPGTRA

SEQ ID NO: 22 - protein, 736 aa, Heliothis virescens nudivirus
LPKVESKVVVEAPKTVEPPKAESKTVDPPKAESKTVDPPKAESKVVVEAPKTVEPPKAESKTVDPPKVEVKVVDPQSKTVDPPKTIEPPKTVETPKIVETPTIVETPKIVETPNPSTPPDFDEPSMESFDEPMDVDEEEIAPAFNPFNVVDKEHEEVKRKEDEAKRKKVESEVEVHKDHEMHSSEFEPPSIDESEETETDEYKASAAAFKNMFSSMDAGEMPESIQRKDPKIVDVPPKTPPTLPKVIDVPPKTVEQPKRKKEPKRKEDPPKTIEQPKRKKESKRKEEPPVIPKTIEQPKRKEDPIKETPKVDDGEAKRKADAEAAKRKADAEAAEAKRKAEAEAAAKRKAEAEAAAKRKAEAEAAAKRKAEAEAAERKRIADEIAAEAKRKADADAAKRKAEAEAAKLKADAEAAAKRKAEAEAAEAKRKAEIEAAAKRKAEIEAAAKRKAEAEAAAKRKAEAEAAAKRKAEAEAAAKRKAEAEAAERKRIADELAAAKRKAEAEAAEAKRKADAEAAKRKADAEAAAKRKAEAEAAKRKAEAEAAEAKRKADAEAAKRKADAEAAAKRKAEAEAAKRKAEAEAAERKRIADELAAAKRKAEAEAAKRKAEAEAAERKRIADELAAAKRKAEAEAAAKRKAEAEAAKRKADAEAAERKRIAEEKRIREEQAAAKRKAEAEAAERKRIAEEKRIAEEKRIAEEKRIRDELAAEAKRKADEEAKRKIESGEFKLHSRI

SEQ ID NO: 23 - DNA, 152265 bp, Heliothis armigera nudivirus
  source 1..152265: mol_type = genomic DNA
gtgctctaaaatgtcaatttgcatctcaaagactgcaaacttgtatgccttaaaatggtgccattaccgtgtctagttttgtactttgggctttacttttgggctttactttagacgttaagatactcgatttagatactattcttgtcacaagtgaaaccaatgtcacaagtgaatgtcaaactaatgtcacaagtgaawatgaaaccaatgtcacaagtgaatgtcaaactaatgtcacaagtgaaactaatgtcacaagtgaatgtcacaagtgtacagtacaaatgtattagtgttaagattgaaccaagtatggttatttagtagtaggtagtaagtagtaggtagtaggtagtaagtggtaagtaataagtagtagtatgtagtagtacgctagttggttggtattctagttgtttagtatgttagctgtttagtatgctagttagattcaactattgatttagtttaaattataaagttactgttgaagaggtagtgttataaagttactgttgaagaggtagtgtttaagagtttgttgaagtaaagttactattgaaaagttactattgaagtagatttaagaattgtgtgccacctatgaaaaagactatacttgcccatctattttatagaaatgtattttagagtatttttagagtatttttagagtatttttagagtattttagagtcaagtttatattagtattttaaagttaactatatttagatttaaatacctagtagagttatatacaaatgtcaaatatcaacaagatgaaatatcaacaagataataaaaagtgtttacaacaatcaatcagacttgtatcatttaaagtaatccaatcattgcatccaatcattgtatccaatcattcaagcaacccattaccagattgcctcccagactaccattcacttggctaaagtgtcaattgccgtctttcattgaactcgcacatattgccataataatactacctacccactttaatccctctctcactctaaggtcaaacctcaggcaaattgctcaggtctcagatctcagtctcagttctcgggttttgtttagaggtttataccaagtctcgccatacacacacttttcagtactctggcaaaaaatgtaaacaaacacagcaaggatcaaggtttataggaatcagtaaaataccaaggatacagtttacacatgcatttattgaggtttatttataggggtttattatacagtgtacatttatggtttgaaataaaatgtaaaacatgattaaaattacacttgtaaaataacgggtacatttagtataaatggaatggtatacaagagtgtgtctttagtaataagtgtctttaataaaaggtttagttcatctaaatatagattctttattacatctaaatataaagtctaaatataaagtctaaatataatggctctatataattcctctataatcctctatacaaagaatacaaaagtacaaaaaaagagtattaaaatagtaggtaggtaggtaggtaatacaaaagagtacaaaaatacaaaagggtacaaaaatataaaaagagtacaaaatacaaaagtatacaacgagtcaaacatggcgtggtaaaggttgaccgtgtcggtcatctttacaccaatcatgctcttgaaatctttggccattaaagttttacgacccgagtttaacattacaatataggccgcctccaataaccgagccagatagcactcggtcacgtctcgcatcaacaacagagcctggcccctgtatcggagatgcacaacttggtaagagtcgatctgaatttcgatattcttccaggcacgacaaaaaggcaaagtcggtatgaattgcattttacacgatttggacttgatcaatttaatcatgtatgccacatcaaacttttcatcttttgcactaccaggatccctaccctcgtaatcgtaatcgtctgccaatacacgcaaacctacagactttagaatagatttaatgtcacgaatctctacagtcttgcgcttaccgcactctaccagcaaagtcacacgacgctttacctccttcatgaaaaactctatgattctactcagctctggatagacatcctttgagattctatctatacccaatcgttcagcaaaacgtctgataatgttcttgtttataaagttgatgctttgagactttttaagacgctctgcacgcatggcggcaattctactaccgccaccggcttcactagagattttatgaatacgcggcaccttggtggcaatgggtagagttctaactgtgggcacattggcgggagcctttacaaaaaggtatttgttttgggagctggagattcgggtacagagtttgagttgttggtattgggtgtagatggttcagtgtttgttgtaggtgtagatggtttaggtttgggatcagatttagacttggaaacggtttcggttgtttcagtgtccgagtcttgatcgtcagaaatgaactctttggacttgtattgcttggaacgtttggatttagaattggatatggtcttgtacggcaatggaagggttggtatagggataccgttagagtccactctaggagtggtgggttgtttaaaaataatggtaacattttgatttggagtgttggtttgaggtttggatttcgggttgggtttcggtttgggtttgggtttggcagcagattgtttaggagcaataggtttaggaacagtagtagtttgtttaggaccactagttggttgtttaggatcaggtttaggagacttgggtgcagccttggtgctttcaacagaagaagcaacaacagtagagttggactttgtcgttttgggtggatgtctcctttgcattggatgactcttcatcctcagagtccgagctaccactactatcattgtcgctactaccactatcctcgctaccactgctctcttcatcgctactgtccgaatccgactctggtgccggtgatttggattgagtggggttaatctgtttacgagcaatcggtgttttaggggcagtctcagagtttgattcggacgcattgggtgggttagagtttacactagcatacacccgagtcaaattgcgtattagactctacgctattggccgcagtgtcgtaagtctgatagcccttgtttgcagtgtgatcaaacttgacatactttttgtgtctgtattcagatggtttgttttgaataatgggtttgatcacagtcgcatcctgagctgtagacttggcctgatctactaccggtttattaaaagatgaaacactaccgctactagcagtggtagcagttgcgctagcgctactagtattggcaatggtgaatgtattacctgccgactctgctgcggtagtagagcgcgtaaccatagtcttgatgccggccgaaccactactacgtaacactttaccgccgccgatattctccttttcatgtgtacgtttacgactctgcattttggacacgtcaacgatctcgtattgagtgtttaataaaccaatttctagttctgtgttgccttgacctgaatttataacctctttgcgcgggaactcgacacgtactgaatttagcgcctctcccttctcctgcgcacgcgggcgtttacctactacagtagtcatgacactattgtcgttcttgttgttattgttattattattataattgctgtaatctacacattggtcctcgtcatcggtttcgataccgctacgtttaggagtgccgtccgcgtttatacgtttgccgatagatggagccgccctaggggtatctttaaagtttattaagcttgtcctcttcgagttccagtgcatgttgcatgtcgggagtcggagtgtttagcgtgtctctataaacaaaagatgatggaccgttgggataagtgtttggatacatcaagttgttgtatacaaactcgggttgttgatagtactggggattagttttagaacgggacactaagagtaaatttacaattgcagtatactaagagtaaatgaaaagagtacacaaggataaatgaataaagagtaaagtaaaatagtaaagtaatacaataataaaatagagttaaataacaagagcaactgggatgcaactaaaactacaattcaaactataatgcaagtcctaaaatacaataacatgcaaagtaaaactaagatgcaaagtaaaactaggatgcaaagtaaatataaaatgcaaaccaactctaaacgccaccagcaaacactataccagcatatactacaccagcatacaccacaccaacacagcaggcagagtttagagatgtgcaattttaaagtcacctggttactttactggtaaaagtgcacaccagagtacgagtcgctcagagcaaccggtagagtagcaccacagtgcagtgtagaacagggcaggagcaagtttttagagtacaagtctttggtaaaaatatatttgatataaatgacaagtctttggtaaatatactttggtatcgggtattcagagcctaaaagacttctgaacaattacaaatccagcaaccggaatgcaattaaaacacttgtgtttggaagcaaaactcaaatccaaaatttaattcaggaattgtaggtttacgtacacactggaatataatttgcattaattcgggcaaaatctagccgtctagccgggatctaggagctgaatataggtcaggataggttttttgcttttatatggcctagattccaactttggaggggtgaattaaaataatagtcgagtcgttttgttgtatataatatagaaaattgtatttaacttaatatgttccagatacctaccgtacgcccactgaaaattcttcatataaatacgataatggtaggtgttggctacataatagctttgtacgtacattttcctgwttattcagtcagtgtacggactctgtgcggataaatactgttattctccgagttttggagtttttatctgaaattccaactcggtaaaaatcacaagtctgtgctacaactcaagtgctaactctgatactagtgattggctccaacactagtgaacaaactttaccaagtgattgactctgatactagtgatttacgagtttcgtggtctgcgctgcgaagactctcaggagaaggtgattttgaaggaactcttttcggtgtctgtaatatttggatgtttaaactttttgattgacttgcatcaaaaggtacgagaggatcaatccgccatggtcatcaaagagtacgagattactgtagatttaaagtgtctgctcaaaagcaaattgttgaattgtctaactctgctcggggacgggtacgctcccattagaatcattcagtcctttaattaacgatgacgatcacaacaattggcgtttgagcagagagtatgtatgcgctaggaacctgcgtgaaaagatctctaccgactcgaccacttgtaccaacattgctgccaatgctggcactggttcaggaggtggtgtcggtgcttctagtgattcctctaaggatgctaatgctagtactagtggtgtcagttctagcaaagctgttgataatgtaaactctagtgttgacaactctagttttaatactggtgtaaactctagttctgatgcgagttctgatgcaagttccaaggtaagcaacagttctagttccaaccgttctggttccaacaatggttctggtaaaaacacttctggtaaaaacaccaacagcggctatacacctagcgactacaagtacgattgcggtagagacataagggttggtgaggacgaagaggacaatccgactacgactctgactctgacattgaactcatttcatctggtcccataccgcaaccgtttggctctaaaagttccaagtttaaatccaactccaagtacagtgccagttttaaaaccaaatccaagagctcttctaatctacccaaacattctagctctaagagctcctcttccagtaagcattcatccaagtctcgtctagttccaagkccaannnngctgccrccaagcctgtagcaaaggttactcctacrgccaagcctgccgaggccaactcygcttaaacaaccaacttcatccaaaccctctgaaaagccatcagacaagtctactaatactactactaacactactgtttctaaaccaactttaccyaaacctacaccaccaccatcctcatccaagcctactccatyrgctaactcaacctctaactcagcctctaactcaacctctaactcagcctctaaatctacatcaaaaccaacctccaaacatacatctaaatctacatcaaaatccaacacttcaactgcctcaacctcaacctcatcctcaacctcaacctcatcctcatccaaccgattatcaaccgcccaaatcctagatatgattttaagccactacctaaacggagacattgactctctgcgcaataggccaccaagacctcccattagcgaagccgaagcggccattgctatagaactgcctcccgaaaagggggccaactggaaggtcaccaagactagcgacgcaaattacaatgagattagggtaaagcgtacgataagtgttccgaaccgaatcgcaactctaccaaactgctcgaagtctccacaatgattgtggacggtgtacgtgtcgatagggttaaacaggttttgcatgagattaacgaaaacgatgaacgttctctggtacgcgttgatgatggtgtagaagagtcggactctgacgaacaacagccgactgttgaatatttcatgggaggacgagttgtacatttctgatgagggcgaggagggtgattgtgatggttctaaaccatcaacatccaaaaatgtcaccaagactagggttgcggtaaaagagttggccaaatccaataattggtccaagctgaaaaagctggtaaaagagtttaaagccatcgaggctaggcttgctgacattgatgactcggacgaggtgctcttgtgcaaactggagcgtaggcgcgaacgtatacttagaaaattcaaatcaaccagcggtgtcagcatcagggtgggtagtctgttggaaaagctaactatgaatctgcccagacacttggtcgattaccgagaggccctagaggcgtgcatcctcaacaatagtcgtaaatcgttaaagttaccaactgtcgagactgtaaagcgtgccctgtgtttgtcacaaaacgatgcagttgaactgctcaagtgttgtatagagtcgttgcaaaagattaacggtagggatgatgatgatgatgatgatgttgacgaggcagatgaggatgctgatgttgaggatgagttgtaggttaattgttagttgtaagaaagaattgtaatgtatatagatgtaagaaagatttgtaatgtatatagttgtaagaaagatttgtaatgtatatagttgtaagaaataattgtaagaattgtaagaacaaatattgaacaaatgtagatttaaggattgtttattgatcatgttatacattaaatgtaaactctaaactgtggtgttttataatctgtgttattatattattacattattttacattatttgttattatattattataccttcattcatacccttcattcatacccttcatttataccaaagttatacacaagttagggaacctagttaaaccaaagtcggaggctcatacaatttagggaaactagctaaaccaaagtcggaggctctatacatgcaaacataccctaccctctgtaggagtgcaccaactctgtgtaaacacactgagctcaaaatgtgccacttttgcatatacacccagtgtatactttattgaaaattacaaatttattttcaatgaatcaaccctgtaataagacatgttgcttgttaagcgcagtgtgcatcccctatacgtcatgtcagatttggtacttttgaatcgtccagtgtcagtcgagaacggtgcaatcaacgccaatgaactggcagaggttctgggtttcgatcgacacttgatggtcgaacctaccaaaacttgaaagatgacgaaaccgacactctgtacattacacgcactggatttctacagatcctggctgcaatgcaccacactaccaagcactctgacctggcccgtcgtctgaccgaatccaaagaggttctctcctggatgggcttcactcgtaaacagatggagtgcactctgaacgtgcacaagattaattatcgcagccgactaacgttcggtgccatggctcgattctgtagactggtcaaccagggttttgcctatgcctacctgtgctaccctaaagacttgtgcctctttgacagtcccgagagacgcatcatcgacgacgacgctctgatcatgatcgacaacctaaaggtggcagtgtttctgcaaccgtttacgcagctcgaactgcaagagtacagagccatagccgaggcaaagggctacactctgatgacgctaaccatacgaggtccggccaagttgttgggggttttgatttacaagttgctaaatgtgtagaatgggagagagatgtagagaggtagagtgggtatagatatacacatgacctaaaggttcatcacaaagagtgccatattagatgttagctgttagattaggtagttgcaaaatattttaatcatttacaaatggttatatttaaacaacactattttgagcaagtgttgtattctattgtattgaactggaatgaaatgaactgaaagaaattgaatctgtgttacatctatttttattttttagcatcaatgtaacwnttgttgtattgttacaktgtcacttgctacttgttattgtcgcttgatacttgttattgtcacttgctacttgttattttcacttgatactatacacccactttaaagactcgtagcacgtgtacaatattctaaattcagagtatcgtattccaaaattcagagtataatattccaaaattaagagtatcgtattccaaaattcagagtatagtattctaaaattcagagtataatattccaaaattcaaagcagaatatcacaaaatttaataaaacactkatttaagtataccatcacaaaatacagaattcaacattacaaaattcagagtacaatatcgcaaaatgcaaaactgagcatctcaaaattcaatgcaaaattcgaggttttaatgttgtaaattggattatgaaatatctcaaattttattaaaccgcagtctgtatattgactataaatcatcatgaaattcaatctggagtttcacaaaattcaatctatacggtcgtaaacgagagttttgggtactaaaaatgcctggtaggttgatttacaagagtagatagtgttgggaataaaagacatttgaatatatagaaactttgtttatttcaagtttagtacaaatcacattggtcacatctagctgtatgtttgcatactctttaatatttacaaaatctcttacaagtctactacacccttacacgtctactacatctactatatacaatcatatacactywtatacactmnnttatacactaatatatacagtaaaatttacaagtcaaaatatacaatatgcaacactaaaaaactaaaactaccaccaactctaacgtcaactccaacgtcaactccaacgtcaactccagtctcaatccacaactctatacacgcacccgctctctctaatctctaaacatcaaagtttaaaccaacaccataataggtctccacctccaccgagtgatgtactttaatccgcttgatggtaccctcttggtgctcctttatgtggcgtttgcgacacttttccaagtacgacaccagctcgggttgcttgaggcttcatttcaatgtacaactggccagagaaacgaaacgccaactttcccaagattacatactcgggcaccttgtagtctaccagtaatggaacacttcagccttgcgcagttcagcaaacatgcattcaccgctacggatcgaagccaggcccgattcgatgcacggagggttgcagtacacagaatgatgagcttatctgcaattgcaagtttatatactccaaccaccggatgttgaaaacgtgtccgtttaaaaaataccatgattcacaaaacagtcatgcataggaaaaagctttacagctacctataaagtgagtatgcaattatggataatacgctattggtggtataagaagcacgactattgtagaatacactctggtgtgcgcgcatttctaaacattcaaacatgctaaagactagtgattctagttttttagactcggtatttggtaaatgttgtagctctatgcattcaagtactggtagttttgggatgcccattctactctagtccattttacatacactacaacacctctccaagcaacacctccatcaaacccattctaacaatgagtctcttgcgaaagccaacatcagagaccgagtttgatttggaagatttaaccattagtctttcagactaccctttgagcaatcacagcatagtcgatgatattcaacacttgatgggagacctctactaccagtgcaacgactcgacgtgcccactctcgacaagatcaaacagatgacgagggtttgggtacgagcaccgaagagggtgagaatgcggatgatgatgacgacaatgaagaggccaccgactatggtgccagtaccgatgaggatgacgatgacgaaagtgcctcggaatggggcaacgaggtgtgtttggagtacctagtgcaaaacaggggccactgtattgcacgacaaacatattgaccatgctagtagaacccaaaccagaatcggaatctacccgtaccaaagtttttcgtttaaaacaatctaaaacaatctacaacaatctacaacaatctagaacaatcaacaactacctactacaaaacctcttgataaaaatcaacctctgattttgaatcctacctccagaccacactctacaaaccaatctttaaatcaagagccataaacaaagcctacaatcagagccatagactgcaatcaaggcctgtagtaaaatcctcacaaaacgtataatcaaatcacaaagcctacaatcaacgtgcaactcctacaatcaaagtacagctcctacaatcaaattacaaagcctacaatcaaatcactaaaactgtctaaaacatgtgtgtgtagttgctaaatgtaaatactagatgtaagaatacatgcgagtgccctagatgtaagatactttagatgtaagatactttagatgtaagatgtcctatatgcaaaatacattagatgtaagatgtaagtttacaattccaagtaggtacctaataaaaactttacaaaatataaaatcttgttttttaaacacaaacaaatacaacgcatgtaaacatgaatgttgaagaataaccatgaatgtcaaaaaatacacatacacattaaaaacagtttaattaaaaaatgcatccactctgcatctacataaaaacacggcaaacataaagataagactgatgcatcaatcaaacaagtttagtggcacagcgtttgctcttgctgatctataatgtactgttcgaccggattcggagagtgcactgccgtttgattctttatggtaggttttaatgggaatattggaatgaggctagtggtaccgttattaggttttctgatgggttttaaaaatatactcgtagggagagttggtttgtgtgtagtagagggaagcgttggattgtgtgcactagaggaaagagttgcattatgtgcactagagggtctagttggattgttggatagtgtaggtaatgtagcagtggttgtaaaagcatcatgtgtagtagtaaaatcatcacgtgtattagtaaaagtatcacgtatagtagtattaaaamcatcatgtaaagtagtagccacctctggtacactagacaacaacagctctggtagaggttcaaaatgtggcacgtctctttgcactgatgctacatcaacacttggctcgtcagattgtaacagagtcagagggttaaatttaaactttagtgttcccgattcaacatttggtagagcgtagctattaataatacttccaacgccgaccgatttagcatcgataaagtactcggaaatggacacattaaaaccgccaacagtggtcattattgaaacaaagggtactgtttcatttgtcgcaacaggaactcgttccagtgtaaagcgactgtcggggtcaagcgagctatcgggacattgttgattctcggaacgcttgaacagaaacgtttcagtgtttgatacgataagctcttgctgatgctttacagtactggctttgttgttgttccaagtgtttagatagtgtatcaacaatggcacagtactctggcgtcgagacgtttcaacttgagcagcaaccgacgctcgatgcgtttactggccacggttgaattggtcaagtttaagcgtttggcaaactccaagacacgggcactcctaatgaccgaatcggtacacacggcctgttcgtttatggccgacaccgagtctgttttgtagggcagcgaagagtcggtgttgtacaagagcggagacgcacatcgtgcacgcccacattgctaggtgccaaatctcggtcaatgcacaggaagccaaacactgacaatcgatagtttatgccatgttgctatagttgctgttggtagttgatgttgttgatggttgatagttctgatgtttgatattgctgatgtttgatactgatggctgatactgatggttgttactgattgttggtagacgtgtttctagcagacgttaaactgtaacacaaagggtgcttgtattaggaggatgtatcttgttttttaaacactmttaagaacattaaaaaactacaacactaccaactaggaatataaaacactagatgctaaacattgataaacataaacatcaactctacactacaacaattcactcaggaataatgcacaaatacatacactcaagaatacgaatataagaataacagaataacagaatatcagaatataagaatataagaatatcagaatataagaatataagaatacaagaatataaatacctagcaattattattakacactayaaatgaaacccaagaacaagaggtacccaccaacggtaaaacaccaactgtggccgtctgattgtaaagcaaatctcggcctccttaaatagtagatgaccgattcatgtgcacatacatgtgtgtgcgataaggtagaggtgtacggtgagctataaactttacacacctagttttactcttaaaactcaggttcaacgcagtgggcatagtgctactattcagtcagtggaacactagggttattgtttctggcttttacattgtatgaatattactctagactttggcacacgcagcatacaccggatcggtcaccgttagcgtgttgattctctgctgcgtcttgggatggttgacttatccttgtggtcgagaatcattcgtgccacctctcgattctccacaacggtggccagattgtatcgaaacacgtgcagtccaaaacccggatacttcagatggtaactcaccgtagacgtggactgattgaacaaaacatcatcgataccgtagcgctcaaacgcctccagttccctactgtaaaactcggacagtttacctagaaactcttcaaattgattaaagtagtagactcgccattcggtgccgtttttgcgcttcagcggtatcgttctgtctttgcgcaacaactgccacagatggctgactttgatgcgattcacctccaccgaacgcaaccctgtatagaatgttttccgtgtccgggtcacggttctgaggtgggttgttcaaatcaaagaccatcggtgagacaaacactttggtctcgggccaaaagagcggtttcagtttcctaaattaatttgacgcacaaaggccagtgctctatcgtcgtcgttgtcgtactgttccagatgcatcatggccacctgtttcattagcttgttaatgtacggcaaacgtttggcgtgcttaacgtaggccgcataggctttggcattgaccagtctgactcgtcgtcgtctgagtctgcgtggtctgtttcgattgttggcattgttgacgattccactagtattggcatcggtcatgtcatcgtctccgtggtacggctctggctcacacaacggtgcaaacgtatgatacgtgtagaggataaagtcacgattcagaaaaggcatacacgccaaggttttagaattagaaagatgcacgttacaaaagtcaagagtagaattagaccatgcatcttagcatggtgtatgaatatgaatgaatgaatatatgtgtatcaaacaaaaagactaatctcttgttgaaaaaaattgatgattactttaacatttttacagtactagacatttatcaagtattattaataaatgtagctactaaaggtatttgctaaggatatctaaaggtatttaccaaactgctaccgagacttgagatttactctgtttacttttgtacactatataagtgtatcagtgtggctcatactcatactcgtactcatacattaaatcagctgcaagtatagttgtactttttaccagtatactttttaccagtataccttttaccagtgcatttatcattaaactatacttgaacaaatcactacactctttacatctgagttcccctcctggagcccctgctgcggctgcgtgagcgagaacggctgtgaatagggcactmtctaaactagacactgggtgcatacaacaccaatacggtattggcactatgcaccacaatagcaacactttacatgttacggaaatgtgccaaattcacacacggtccaggtcgtagcacagtgtggaaaatctaaagatgcactgcacactgaaaaagtgaacgtaaacgccttgtccattgtttatagcaaagtgcatgcgtatgcgttcattgttgccgtcgacgcctgatgttccgtaacacactgcgttaaacttgcaccggacgcaagattgctgttcgattgcccacagtcgagacggaaacaggtcgtctacgcacatggtcggattgtcatacttggacagggtcacttcgcattcgaatccctgcgagtttagctcgcttccgtatgattataccgttggcgtaaaagtcaaacttgtcgcatttgctctgaaactcgatcaattcagagctgtccttaaagttttctacgataaacaatcgaccggctcctttgaccttttggttgcgtatggaacgcctaatctttttcattagcgtgtctacttttactttaggtttcagtgatgaggattcagagttagtgtcagagtcaggttcaggttcagagtcagattcagtaccttgttttacgttctgcctcagattttagttttatagaatccaagtgtaattgcaagtcttcgcctggatcaatttcaatttagggctcatccgaagtgkaacartcggcaaatacacgtctggccacatccaagcgttcctcgtacgtattgtccagtatggatttaccattgaccagatagagatccaacagtacaaaacaatcatgtagtacttgcagtcttccgttaggcacagacacaggtggactcccttgaagctgggctgtacgcaatagtcgctgcacatggcgtccagatcggaaacgttgagcgtggcctccgtctcgtaggatacgctcggcagtttgtagctgcgagtcagatcgttgacggtcacattgagactcatcgacgatataatgtaggcctctagcggtgtgcattgtttcaagattaaatgatgcggtgtcttgaacaattgtacaatggtcagtctgtcgtcgttggtttgttttttaggacaataataattactggcatgtctagacgttcaaatgacgcacactgttgactacggcgtttattgcaaggctccaattttacagtgtctataaattcaattttatttagcataaccgttgaggaatcggccaatctctatgagtgtaaccattgtgtttatttctaccggataagaaggatggtaaattctaaaaaacaaagtcaacattattctaaaactatattctttaacaatttaaaatacaagtgtaacaattctattaggtactacaataaatactaaatactttgatattttgataggtgcctatgttcaacttgaaacacacacaaatcaatttaaagaattaccaccagtactagtactggctctatttaaacttttaaccgctcaaccttgttcataacatctgcgctatcgatccgactacgtttggccatgtacgcctcgtagtcaggatcgcgaatcgtctctctcggtgcacaggtcgtctgcctttgaatctttctgcagttccattgtttgctacattgtatgacacattattcacactgttaatactggctgcattgtttgcaccaccgatagcagattctttaataaacggcttgtaactttgttcgtttatcgtattggtgttatcgctctgccgagtattgttgtaatcgttgttttgcacgttcacatcatcgtcgtcgtaatcgtcttctatctgaggcggtgccacaaatggtgtactcggacgtttacgggtggtttcgggagattgtagtagagttgtggattttactgatattgtaggtttctgtgttggagtgggaataggtttggtagtgggtggtttaggaataggtttggtagtgggtggtttagtaggtttaagagtagtaggttcattagtggatttagtgataggtttagtagtagtagactttagagtatttatagctgctaagttaggaatgggtttatttgttggagtagtaatgggctcaagtttggcgactcttagtgtagggtcaatcgagactctctgactcctcgcatcatctcatctttcaagttttgtatagtctcattatcaatgccgccagagagtccattaccattgatgccagcaatcccagtattgctcatattggctccagtaacagcaccggtaccagtgccggtactctccgatgcaggcgtcattttactaaaatcgataccggcatcgagcagtgccagtctcagcaagtctccggggtccattggttttctaggtttttcattttttggaagctttaaatttgtatcaaactctgtattggcatccttgttgttgtagttgttgtagttgttgtagttgctactactttcaaaattcactcctaagagtcttgttgattgcatcgtgcctaaccgtcaccattttgtagtctagtggtataaagtctatcgagtcctcgtccatggccaatggattcacttgaaacgtaaagtgtcgtttgatcaagagtgcatgttcgtgtagagcggctcgactcgtctgagcacatattgccggcgattggccgtgtacggtgtctgattgattaggtgcgtgtactttaacgattccaggtgtgcgatcggtacacgggtgcacagatggaggcacgaagcgatgacggtatcgattgtgcgcaaattgaccatacccatgtcgttgactgtaaacgttttaaactcttgaatcaatcgcacaagggtgatggtaaagtttttaatcacgctaccggtcagagttccgctcttttgttgcaacagtccaatcttgggataggtcagagtgactcggggattgagagactttgtagttgtccgtaagtttgggacgctcctttgtaatttgctcaaagacgctctttatgttggaatctttgagcgtttcaatgttaatctttagatcgttcaagagctttaaatgggacgcctttacgttgctcattataaataatcttgatgtaaataatcttaaataacagtataatttagatcctctataaaattagatatcttttctaggagagagaaaggcctccactctctatatagttttgcccggaaatgatgctataaaaagggaaacaataaaaagcaagctgtaaataaatgttgtatctagagaccgagataagttaaactataaaattaaataaaaaccggataataaattatcaacggcactctaccattaacgagtcttaataacaataataaccacattacagttttacaacctctgattagaaattgtaaactctacagaatgaataatatcaataaacgtatagatgtagtagtagatactacacatttatgctataaattaagttacactgtagtcaatgtggtgtaaacttgtctagcaatgggctcggttgcaaattgatattaaatattattattatcaaccaagctacagtagtagtgtagtatagttgtagaggtttggtggggaggtgattatttctcacgacttctcaataacaccactagtcgtcgtctgtcagcagtgttaaatggactgttggttcggtgtagttattattatacttttagtgtaggtcggtgtcatttttaaatagccatataaacgttaaatatcataaaagcaataacctattgaggctacgtttgcgtactaaatttaatataaaaacagtgttttgtgcacatcagcgagatgaatgaaattgagagaatcgaaacttttacgagctccaactggaaggactcgatgattctgggtatgaaattggccaaaactggtttctatttctgtggagcaaatatattaaagtgtaccttttgcaagtgcatcctcttgtggaacagcaaagagtaccaagagtttgtaaacaaacctcaattgatacacattcgtttgtcaccaacttgcgagtatgcgtacgcaaatctacccatgtacgctaatccccagtatcggtatctcaagtcgagactcgattcgtttatcggcaactggagcgtgttcaagaggcccactccgatagcgttggccgaggcgggattcttttatgctggcatggtcgattgtacaaagtgtttctattgcgacggcggactaaacgattcaaaaagggcccactctacgtagagtcgataaagaagaggattctgggtgagttgtattggttgttgttactattattgttgttttaatatttagtgttgttttaacatttataaatgaacacctgtacttgtgcacatgtatcgactaaatttacactcttatatttatactctcactgggcggtaattaaattgctgcaaaaagtagaataagcgatcccttgagtgtgtacatccttcaagtgtagataaattaaattaattttgtctataaattaattttgtctataaattgattttatctataaattgatttcgtctataaattgagtttggttataaattgagattgcaataaatttagattgtcgtaaaccatttcatctgcatcatttatttaatgcaggcatacatataaataatctaaactacatacactcgctcgctctctctgtactgttacattccacctctgcataatacacactaacctttgtaaatatttaaacatcccattccatgtccattcaaggtggtggttgtggtgcagaatcctcagagtgcaatgattgccaatttgacaaagctggccgcagatgcaaactgcaccgagtcaagaggagtattgttgaaagctttgaatctacagatgcgactcccaatgtagacgttgacggaggtgctagtgctatcgagaaggctaacactatggatacttccaacaaggatggtgttgtggaagagacaagtgttgttgttaatggtagcactgttgatggtagcactattgatggtagcactattgatggtggcattattgataccagcaacgttatcgaggcaatcaacactagcggtaactgttttgtacattttctattgacagacactcgtttcctgaattacacattgtcaatgcacgcttccttaatacacattgtttatacatgcatgtacaaataaccattaataacaaaaagtaccatataaaacactctctccctctatcctccacagatgcatcgaccaataccaacatttcgataaactccaatttatcgctcgtgcaagaccaccgacaccggagcgctgcaatgtacgcaatcggcctcggataatctacgtagacgagaccattggtgagttgtaaacgtccctttgtgcattaccaaaacttgcaagtaaacttgtaatttcagccactactgttgctgctgctaatgtttccactttagtgttggacccttcaaaatgttcaaactataaccgagccagaccgtcgttaatttataccaattgtaaatgctattacaataatagtagccgcaaggatagttgacctgattcagagggtgattatttacacggtatgattagtgtgatctgctcttagcaggtacttggttgataaatatgtgtgtgtgtgcatttgtttttagagcaatgtttaaatgtaaatgttaatataactgtaaatgtcaaatacctacaatatacatctctatgtgtatagtaaaaagatgtttataaaatcagtatacttacctatatgtatattcaaagttgaaatctaaatgtaaccttctacaaatccatctacaaatccttgtctttacacatttcatgcacagtttaatggttcagagaattatgtccagtgtcaaatgtgtagacgttagtttagtatagggccatgtataatattctagactcttgacaccaacaggtttgacaataaatccaatagtcatgccggctagttatagtcaaataacagtcgagttataataattctaatttattgttgttttaatcatttactgttagttttggcacgttatggctagttactgctagattgatcatttactgctagacctttagtttaccgttagtttaatttacgtaattagattactgtttggtgttgcatttgttgtgttttgtgtttgcatttgcgtgtgtttggtttggtttttgcatagagggtcttgtgtactcttgcaccaaatgcattcttgaatgtaaaacatgtatattcttctcatacaaaccaacctccatttcacagatgccgatgccgattctaccattgaagatgaacattcaccgattgactcttctggtagtttggttaaacctaacaatgatgctactgctactacttttactgaaaccactaacattagtactaccgccaacattgatactcctcccatcaacactgatactaacagcaacgacacttttaacaatgcatcatgttgtaatacatcatcttgtaatgcatcatctggtaatgcatcatcttgtaatgcatcatcatcaacttgcaaaatcacaatcatcccagactataacgttgcacactgaaactggaacaatagacctttgtactgcatccgaagacgaagaggatgmggatgcaagtgactacattgacgacgaaccctactacagggacgattgcggtaaagtgatttacatcaacaatagtggtccactagagtgtagcgtgtacgtggacgaagactgcacctcggatactgaaccacggccagagtttaaaactatacagattgtcatcaagtctgaggatgtgtccagaaaggccaacaagtacaatactcaaaatagtaccaacaattttattgcaaacaataaccaacaccaacaacaacaccactagcaagtatacaaacattgacaattttatgcattttcatcagtattacaaaccacaaaactatagcagccagaaccaggcactggatcagatgcacaatcagtttaatcagattcagtcgtttaaccagaatgcaccctttaatcaatataaccaaagtcagacattcaacaaacagtgcaccaacagtcaatgccagtgcaacatcaacacttcctattatgaatcgccatcaaactcttcactggactcggcctcatcttcatcgtcttcgtattgcttttacaatcgcatagattcactaaatggcgttattagcaattctataaacaagtctatcgaacgcaccgcactcctttccatttccaattcgtttgaacgcactcctccaccttgttataagcctcctccccggtactcatccccaaagtttcttacagttgacgcgtccaccaacacggagattcagaagtggtggtgtaaccaaggttggagtttgaagttgacgtcggtgtaattgttacaagttcaaaacaacgggatatctaaacacagtttatttaatgcacacaattgtagatcaaaaaactagaatgattcaattaaaactacttttaatttcatcttgatcattttcacactattgtaacttgtctctacatactgatccttttcagactactttcatactactattcatactactgttcactacttttcataggtactacttttatgctcattctgtggtggttgttaattttagattagtgttttagaataggttcagtttgaatttagaattaaactatatttagaactacagttagaaatacagttggaagtacatgtttaaatggtttacatttagtaatacacaagtagatttagaaatagagttggtgttagatttagaaagagttgttattagatttaaaattagagtataaattattaaacagtgtggttagatataaactcaaaatgtacttttattgtaaacataatccatctactgacactacacgcatttataaatcaacttcatacaaatacatacaactgcatacaaatatatacaaatcatcgtgcagatattgtgatattaccgtgcaagcaactcgtttcgtgcggctggtgcgtgaccaaacagttggacaagtgccccatgtgtagagggccgactgcagaaattatgaaaatttacttttaatatttatatacagcttatcgaccgtaacgcgtatagcctattggtgttataaacggttcacatttatgtagttctgaagcattgcgttgcgagcattctcatactttgcgtgtgagcatactctttaaccttttgcatttgacgataatttaactcgacaccatgaaccgcgtaccgaaaaccaagtccatcacccaccaggagctcaccgattacatgtactatgagagtggagattttcagacaatcttgaaactcgactcgttcaacaagactttgtcgttttacgaacgcatacccggtgagcttgtagaagatctaaagccccttcattggactccggcctgttttgacgagtacgttaaagttatcgatgccgtaataccgggagtgtacacttttgacgttgtcgtgtacaatggtcagcagttgcacattgtagatttactctggatattgaaatgtttacgtacaccgatcgcttggccaagattgcaagtctgtttgtgagcaagccgcccatgcagattacttttaaatcgctgccgacaagcagcaacaaactggaaatgtacaatggcccgtgcgattgtttgatcgtaaaagagctagtctcactaaaccgtactgaagcacgcgcccaccgtcaaagagtctaacggctacacttggatgatggccgatcacgatgaaaagtttgccaacattaaatacttcaagactcccagtgtggcatcgttcaatcacaagacatctggcaaaatggaaatgtacaagctgcagatgcaccggttgtgcgcatagtggcagccagactgtccaagagcaacctgtccagtttgattacgatgttgattgaaaagctgcacttggtgcactttaacgacaacattgaagagtttacacactacattaaaatgttggaagatttattggacaagatggaccaccaaggtggcggcggttccattatgagcactacgttgccaaagaagcgttccgaagagaaggacaaaaatagcacagcttccaagaaggcggacgttgaggaagctgaccatgctgaagaggaagaggcggagtctcaataaatgtaggtatcaatagatgtgtgtattcaatagatttactaataaatgcatctagctataagtttatagaatagtaatgaatgaatagttttagttttwtggtaaagtagatgtaagtaggaggtaagtaggaagtaaagtaggatgcaaagcatatagtagagtaggcgctaaagtatgtagtaaagtagttgagttaagtaacctagaataaaggaatcgtaaactattacaaccactgctacctattcaaactttgacttgctatttgaatcttactttgtagtatgctgtgtgtttgacaaaaaccactgataccttttgtcttgcaactttgcattgaattagggtcgaaatgttaaaggattgtgtgtgcgtgtgttttagttttttagaataatgatactttttattttttagaataccaataattcttgttttttagaatactaataattcttgttttttagactaacagtttgatttataatttttttagactaccaagtcataaataaatatcaaaacatacagttgtggtacacgtgctgggaatcggttacgtttattaggttaatgtgcattgcgtgcgtgatccgatctctactaaaacataatgtcagcgagagagaaatctattagaggtgttttctaaaatgtaaattataggatataaaattaacattagcatatagtctaagggaagttgcgctgagagatacttttgcaaagttgtaccggatgcattgttgtgtgcacatgtattgtcctgtttgttcacattttactgactagtgtagtagtagcgttattattttagcattgttgcactgtattgttgtttcatagtaagagtagtacaagtctctctgacttgagctttgctttgcacgattgttttgactgttctttgaattggatttggtattactatgtaggattaagtgtactgaaataaaattataaagtactggaataaaattaaaacctgttggtgataagtttggtagattatgttttttgatagttgtaatattagttgtgacagttttatatagttgtaacacttgcagttggcaaagctataaagacggcttgtgatgtaatgtttatttgctaacctatacttgtagagtaagtaggtacctaagtaaataagtaagtaagtaagcaagcaactgtaagtacacaaactccaactcgtcattctatacgtttttgttgatataggtaaagagaggtagagcacggtatatcaggttctaaacaagccaatcacttgtatattaacatataacctccaaccgagtacccttattgtaaacccatccaatcctagattacttgctacttgcttgaataaatgttgtgtagtataccaacacgtttcatttcaaagacccaaacaaccttacttgcaagtctacccaaagtgcccatataacaaatatccagaaactaaaatgtccaacaaaagtggccgttgatgggtttagataagcttacacctttccccgggcaccataacatttacgatttccgtagtaaattacccgaccgttacctactttatttataggcgtgtaatttattagcattttatgaccaattcaacaatttacaacaacattaattagcattgtaagtttgtattatgaataagaaaagttgatctgagcacgcgcacacactgtattgtacagtgctgtgtactgttgcaacaaagttgagattgaaaggtcaagtgtaaacacacgttccgtgcattgataggtagcagccggtagccttttggagcaaaagctgaggaagtagatgtgtttactacaatttagatacatttatttatgtcaaattaatattcatattcatacaaatctcatataaaactaaacctctagtaaagactacctcaatcctcccatcccttcataatttcatttacacgcaaaaaggcagccatcgwgttgttgtactcggccatcgtgatggttgcgtgcactcctcgctccttgacgttggcatcgtagatggcctttgagaggatctgatagatggtagtgttaatcttggacacaaacttgtacagattcaactgtgaaatgtgtacatcgttcaagtgatgggcagcctcaaagattacatcggtcggtttgtttttcaagtaatcatctttgacgatatcggtacgcgctcaatcaggtagcgctcggccagtgtaaagatgacatcgttccaaatggtgggaccgttcttgtttatacctctcgaagatagacctttttggccattataaagatgaactgatacatcttggcggtcagttcgagttcctcattcagagtcttgcaaaactcgggcagtggattgttttccagattcgagtcaccattgtgtacaaacactgaatcggtatcgatcagtactgccttaaagttttgtacatgagcaaacctggccatgtctataatgtacttgcgtcccagagtggtgagcgctgccgccaccagtctaccgctgaacccaagaggccgtagtagctgcagttgacaatcttcaagttgcgatacaacgagttgattcgagacagttcacccttgagtttaacctcatagtcggtcaacaattgtacatcgttgcatcggttgatttcgtcaaaggttagcagtttaaacttgggcactagcattttcatatcactactcttgtccacatcggcagtgttgaatatagagccagtattgcaaagttccatatatttatcctcagttttagtatcagagtctttgtcgtcctctttaccctcatctttatcctcatcctcatctttatcctcgtctttcgtcatcgtcgtcatcaaaatcaaacacaacctcttgatagtcgtcgcctctattctttaccgcatccaatcgtatctgcatcaaatccttggctcgagatcgtaaaacgttttgtttgtgaatcatgttgcccaatagagacggttttcgctcaacgctcaatattaacacacgatcgttggaattcaagtttttacaacactcgtccaatgaactaaattcatcgcaattattctccagcatattgatcaggttacgagtgtttgcatgatttacgacctcttccttggaacacttgtgcacggtaaatgggtcatacatcgttcactttgcaattgctaaacacttctcgggctatgcgcatattgaatcctccaccgtagctggcctcgttcactcccgccgacacttgattctgattgtacgtcgtagctgagcgagtcccacagtcgacacagcagctcggtatcgacatcgttgtagtgcacaatggtggccaggtcaatgttaaacttttcaaagtggcactcgtcattgggcaggcctcgttccaagaggtgccggtacacgtgtcgaatgttgatggcgttaaactccaccttaccctcagcctgtcccaggcacagtttggccatagtgtccagcgacagcttgcccacctccggatagagttgacgaaagattttaatcaagtcaatgtgaatcatgtgatttccgtacactggcatgcctcgatatagggtaaagtttttaaactcgggcagacacaggtaggcggtgcgtttaatgagaaaagtcatatcgtaacccttgctattgtagcccaatagaaaatagagcctcttacgatccaacgtctgtaggatgagccactaccagtagtggtgtaatcaaaatccacaggcaccggtatattgacaaaactgtacattgtgttggtgccgtgatcctttactttgccgagtccccggactcgtctacaccgaacgcgtaaatctgattcttggtcgatgcccaatcgaggacgtagactcggtcggtcagcgtacatcatcgtgactactaaaccacaaaacggcgtcactaagcttttatatacaaacactgataagaaattgcatttaaaaggcactacacttgcaacgctaccatcattaatatagcgaattctgcaaaggcaatacgctattgtgcttatctttgacgctagtttattggtttatgcacatttttcatcatgccgatcagaaagaatctaaagtcgatcattgcaaaaatattcaagaaacgcttaaatgccaagtctttggagtcgatcattttggatgcattgagcgacgtgcaccatgccagggtgtcgatgagtgatgccaactcgcccttggattatgtggactcgttgagggaaaagatttgtgcctaccatattccgaagcatttaaaggccaaactctttcatcgaactctgccacccgactactacctgtgtccgggcgtcgaaggagtctcgtacacgggctactgtatgtagagtgttgcggtgacttgtttgataggattgatgatttatacgtgttttgaggtggaggtggtgcggttacttgttgagattaatggtgctttataatgtgtttttctactaaagtattatttaggtttttattacctagttctagttatggttgtacttagtttgtacaaataaagattttaatactcaaactgttgtgatttatatttttttagtttaccctgtgtacatatacatttgcatcaactacatccaccctcctactctttcctttatagggctacatccataatcaaatcaaaaccaaagtctcagtttcattagcggactctgggaatccattggattgctttacatggactgaattacaatttcattatgcatctacattggcaggtatcgatcaaaagcttaatttactgggtgtctggtttaatttattgactagctactgctcggctgatgggttcatgtttatgggatcatgtttatgtaatgacattttgagaattgtggtaaaactagatgttggaggctaacggtagggactcggtggtgatttatagagttgaattagttacgagttgaattagtctaaaaaaaatacaaaaacttggtaggtgtatttaaatacatgtaaatttctacctgttatctaaactttaaacttcaactctaacctctaaaaatctctgtatgaaatctcagttcaagtctttgttaaaatccaaaagatatacacatttgaatatccactgcattcaagttaaagattctgaatttaggttactctctcggatttttaagattctacatttgaatactctcaggaatgaaaacaactttgtattttaatcttggtttttattgttcagtttattaggtactagtagttgtgtgtgttttagtatttgattttactactattatagtatgctactatattattattactactgctactatttactactatagtactactactaaaactagaaaatttacagcatttcaaagtgttacatttagtaggaaggtgcagggcagttaaacaactaggttgctcttaaatactagttacgtatctaatactaatactaatactaaatcgtatacaaatcaaagagactttagtcacgagatatatattcatcaatcaatcmtcacacaagctacsatgmraacgtagkasactgcackgcaycaatcttgtacygacgccacttgtacgatgcgatggacatcctttaccgattcgttcagttggatgctctcttcgaacgtgggctgactcagcatcattgcttcatcgtcggcgccactgtattttcaaactctacactgtggaaagattcggcgcctcctttggatgcactctcaaagcgtgcagcactcgcagtcggcaacttgtccaataccgtagtctgaatcgtgagggttgtacgtcatggtggtttgtgtttcgatgcttgatttgtataaaactaaactccaactttacagtcaacgcaaactttaaattaaatcaaaaactaaatcaaactcataactgaaactagtacaacacaaatggaaatgaagtgaccatgacagaaatattgttacctagtaggtacaatatgatggaatgataataataaaagtctatatttgaaagagcaacatgtgctctttgaatggtttgtaatctaaaaaactagagtccaaacgcctactgaaattgtagcygcaacacaacttgagcaactaaattcttacagttcagatatagtacagatcaaatatagcacagcccaggagtagtacagaccaggagatgtacacttgtcaaggtttgtagcaactgaagactatcgtcaaatgttttggtttatatataccgacacaggatgtgacaccaaagggcgtgttgataaaaccatttgttaattatagtcattacacaatgtattagtgcctagtaccacatcctgtatacaattttccttgatttgtaaaatctattctaaaaaaccacagtacgtacaattacaagtaattaaaagagtcggtacaactaaacatgaacaaaagaggcatcttacagtaatacaaacaaagtaatgcaaacaagagttgaaatcttataacctagcacacacatgggagttttaaggaatctaaccaatactaacacnnnnnnnnnnnnnnnactaacaccaatactaacaccaacactaatactaatcaataccaatcaatactaataatactaaaacaaccactcactctcctcccctcgttcactgtaaatgctactgtccgcagtcatcaccgagcccatcaaacgagacacgtcaaacgcaatgtccgatttaacggtggatgcaatcttgcagttctccatcggtgccattataatcttttcggcatccttgttgatcttggtctctaccacatcgccatcgtacaagtggtcctttttcagtttcttgtgacgagtgttgagcaccgggaatgtcttgtttctacgcttctcggcactcttaccaatgttcataaacagagtgcctctacccaggccactggtgcgcacatacaagtacgtcttgtcggcctcctctttgagcttacccgaccaaatgttaatcttgttgattttgtgcggtataatctttatgtagctctgcggcaactgatcagtgggcaaacagtttagacgatccttccaaggggcaggcaatcgtcgttgggattcaccacgtccgtgtaccggaaacaattgtactcgagatcgagtgccagagtgtgcaatttattagcaagttttcaatatagtccaagtactggatgcgctgtgcgaatgcgactcctttgcgtgacagtttgcggctagactcgcgcaaagggtttcagtgtagacacggatccggacacactatagttaccggccaactcctcgtcatcgtcatcgtcttcgatgctagagtttattaaacgtttgttagagtcggttgtaaggtaccgagtcccaccggtgccgtatacactttcagcatctccattgctagcaacgatgctgatttacaacagaattggaatcgtcatcgtcattagagtactctttggtggaatctttagaggcagctttgggctctttgggctctttgggtatgttaaactctttgggtactttggaaatatcctcatccgaatccccatcaaccctatcctccctatcctcctccatacacccatctcgagactcggaatcttcaatgttaccgttactggcactgatgcaactattggcatttccaactccattgtccaacagtttcttacatgattgcacactctagaataggcatcgtaatcgttgatgcaactcgcatccgaattgtatccatcttcgtcgtcctcatcctgatagatgagaaagtaaataatattccgagccataatctgatactgattgttgcgctgcgtaatcttggactctttttcaacctcgggagtgactcgtttacgtcgcagtttgagtgtaatgatgcgagccgttctagtcagtttttgaatcatactggcaaaaatcttactctcaataaactgttcaaattcctgaaacaatatttataggttaaatcgttacatcaaaagtgagattaaaacagtgttgaaaaatggacattttcctatgcatcgaaactagcaggattccaagtgaccctgaaatttacaacaaatccatatgcatggaatcgtcgattctctatgaaaagccagtaatcaatgtccaatacaaaaatgtacaatacttgataccaaacacgatcacgaagcagtttagctactttaaatatgcaatgacgatcaacgcctacaaacatcacatggtcgcgtacatgtttcgtatcaagtacgaggacgcgtgcaaactcataataaaacttacttgggagaatttgaacgaggccatctcgtcacccagagatatcgcactcttggtcgacgatttgaaaaaacccccaaactggacgtttatgacgtggctaatgtcgagtcggccaaactttgaaattgcctacataaattcaaaagacttgacagacgtgcgactgtatcaaccttatgttgtggaatgccacacaaggcgtatagcgtattataattatggcgacattacattgctcagataacggttgtttacagtagggtttgttagttttaatcgcaatgggtgataaaaaacaatggcttaccgtggagcctcccatgtttctatacatgatggccttcatgacgaccacggtcactctttttctcggcaatgctaaccgtaaacagtctcaagagctggcccgtagagtatataatctacacggcatcctttccgagtgtgtgctgtggaagcgattccgatcctatcccatcatgtttgcgatcaatacgagtctaatgattgcggccacattgtacacgatcaggctggcctcaagaatgcactcggagactttttcgatttgcaaaacatcaacactaccctgaatattctagtgaaaaagaggcctggttcattttgctgtcgatggccttttatacgtttcatcgagacgagcgctctgtaatgtacatgtatgcaatcaaagagtttaaatgggacacgactgcctatagccactttagaacctacctgagtgcaatgtacgttacggtgatgctctttgggataccaatcatgagccgaatctttaaatggaccgacacactgattgtaatgctgggcgccgtggctcacatctgtggacacttggtgtacgctcacgcaaagattgccaacctatggtacctgggagcgacgctggccgcactgggaccttgtgtggctccgctcttgcgatcgatggcctcaaaggtgctgccattatacaatggaggtggttcggtacaatyactgttcaacggaaaggttgccgagtaccgagatttgccaatcacaaatgatttgtgtaatccagagtttaggtatttgaaaaatgtaaaagagtttgcgtattaaaattaaattctatcaaataaaaaatgttgtattttttagtttcatcatttgactctagttttacattcttataaaaacttcaagttgtagtactacagtacaaaatacaactcttattttttagacaccaacatacacggcttggaatgagcactaaatttgaaaaatgaagtttgtcacatttacgaccatcgatgagtatggatcgtttgacaacaagaaggccaacgagctcgttagagttttaaacaataatgccaattgtgttggtggattcattgattactcatcgatgtatccattgatttttgtatttgcatcgtgcacagaaatccctttgtcgatcaattggaggctctggtcaaagagtccaagattgtggtcgacgcacagcaagtgtgcaatcttttactagagggttttgtcaatttttcgtttgacgctcgtctgagagtgtgtgacattgtgcgtgtgctagagctgttgaatttaaatgttattagtgttgtatttgggtgaataatgataggtgcacggttgaccaaagtatacacatacacacaccatgaacaacgcaatcaacaatatccgagctcgcatcacacttgcactgggtatcatacaatcggtggtgctggttgccatctcgatcctcttcctggcagtttacttgtactacaacgctgacgttaaggcttcgagcacgtcaagcacggccgatgaattggaaaagaaaaagaagaagattaagaccatgatgattgtatcgatcgtgctggaagtggtcacggtactggcctcattgtggacggtgctgactgctggcaagattaaggactgtgtttcgttggtgtcatccacataaattgaagctgcctacatctaccgagtgctctctatgtgatgcgtaagagtgtatggtatacatcaagtgttgtgttgaaatgcaagttgtacatcaagtgtttartatttaatacatcaagaggtaatgtgtagtatgatcagttgaggtgtttagattaagttgaggtcgtgttagtgtagtttgttttagtttggtatagtataatttagtatagtttaggatagtgtagtatagtgtagtttaggatagtctagtttggtaatttgaattagcagtacatgttagattaagtcacattctttagtaggataggttgctggaaataatggaatcattaagtacaagatttgtgtaataatgatagatgaacgataaatgacaatattaatgaaattgaatatattgaaataaactgaaataaactgaactaaactggaaactaaataaatggattctctctctacatctttggtttaaakatttgtaatttatttaaaacaaactaacaaaatatcaaaatcacaaaatataaaatcaaacccaaaggtaacacccaaacccaaaccccccccaaccacaataaatactatgcctatgtcaacaagtacaatctgcaagccaaaaatgaaaagctagccaaatagataaactctgaggaacacgagcaactcttcctatgttcggcaacacgaagacttgtccaaggtgtcgcagtgtgccgcagagcctctgttcgtagcaccgctcgatatgtggttccctgggccgaatggtggtagtgagtcccagccaagagttttaccacatcaacaagcgtctggcacccggcaagtataagtgattgcatgcaacaacgaactgcatccgtccaccggcagcatactgtgggacaatttgctaaatgcaccagtaaatgcggccaccgtgacactggacgacgagaacgaattggtacccggcaccggaacgtataggttcacgtgcaagtttaacaataccaccaacaaccgagtgctgccgcatcccgcaaaccgattccatcccatcaacgatccgtgcactcgagaggtgcccaaaactatctagaattggagctgtacgagactcgcaactttatgacaccctttgacatcaagtataccaaggttgatggtgtattattaaactaaccgagttttacctttgtccaaattttacacatgagctattgatagtaacgttgaggcggcatgttattagaagtcatgtcaagatgaatcaaataaaactggccaatgctaacctgtacaaaaaggccgcgctcatgtcatggttggagcgcgaccgaatagcgtgcgactatgttaaacgctacggtaccgagattgatgtggacgcgctcaagggactctttgattttgcctctcagctcaagctggaaagcatactggtgtcggtgggcaagtccgtagtacgatccggttccattggcgtgatcaactttttgaccaagattggcatcggcatcgatgccgtcttggaccaagattgatcctcacttggacgatgacgatatgatttctctgattgagcatcgcatcgaaaagttgtccactcgtgaaaccaaaaaacattccatctactataatgtgactatgaaaatgtttggtcagatgctcaatctgaatctggaaaagattaatcagtctatattcaagaatgttgacgaatcggtactggacaagctcagtgaggtcacattcgatacgaccaatgaaaacattaatctggatcaactcaaacccaaaactgatcaagaactgagactgatggaggaacctacagtggttgaactcgacaatgacaacacttgacgtttccacaaacgaggtagagtaccacgagtctgagtttgaaccgttgcccgatagatttggacggtatcgtaggagtgtagtagaggacagtgtagaagagggtttcaatggtggtttggaggatggcttaaaagagggttttgaggatagttttattaggaccgagaatggtgatcttaggacagagaatgatggttttattaggacagagaatgatggtcttaggaaagatgatggtttaggtagtgcaacagagtcgagtgtaaaggatggtagcttggagggattggatgcgtcaaaatcaatagatttgttaaactcattagattcatcaaaaccaacagattcatcaactacactagattcagcaaagtcattaaattcactagagactcaattagagccaccgactgcactagaattggaatcatcaccaaaatcattacccgttgaagagctacaagtaaaagagctggcatctccagttgatgcatctctacaatccaatgctgtacaatccaatgccatggacgtagactttgaggatgatgcaagtgttgcacctctatccaccgagtctatgaatcctaaacatgtagaacatgcatcaatctctccagagccagatacggacaccgataccgatggctcaaacgatttggccaaattggacattttaaacaccatcgaagagtacaagaccaagcagacttcaagaaagcgcaaagcgaccactgctcccagcaagaacgagtggttgttcaaaacgttgaacgaagacgattcccgaccagattcaacgtttaatctctttgatgagcccaatggtgaactgagcggtctggcacaagagccaccgccagacaagctagactctgcaatcatgggctcgtgagcatgttaccaaaaagagcaagccaacgcgcagtgtacagtttgccaagaccaatacagagtttgatgtactgaacaatattaagccctttatcaaagccaagcagggaaagaatcaacagcagcaattgaatctgtctgcattggggttgtctacagtgttgtagggatgtgatgatagacttgtctagatttgtagagttgtatagaattgtttagaattatttagaatagtttataattagtttataattacataggagtttataggtttctataggataggattagtaaataaaagratagtattagtaagtaaaagaatagtattagtaaataaaagatttcacaagtattgtaaaaatatacatatattgtaccatgatgcatttttttaaactctaaattacattaaatatatattaataaaaaattaaaactagtgtatacaaatatctcccaatccttctacatgaatcccctacacaaactctctaaactccttctcaaacaccacattttaaaagtgcgatgtagtctccatcctmcggtgccgattgaatctggccaccagccccaacggtagattggcaatcattcgggtagtattgaacactcgtatcgactgtatgccaaagagttcatccggtgaggcgcccctctccaacagtgcggatcgtagcattttattcaatgtggatcgactgacggtcactattcggtccgagtcctcgttggtgtggctcgttaaaaagtctaggaatttcaatagaatgtcacgtatgtacaagactcgtatgaagcgagagcgcttcttgattttaatgtttaccttgcgaccttcgacaatgtccatcagcgatttcctagtcaactgttgcagttcgttcatacgcaaatttgtacagtaatgtgcaagtttatgtgtaggcacagttgtaggtttataggatggaggtgcagagtcgacctccaccttgaactctttctttgaagtcatgttaaaaaatgagtacatktaaataaaaatgagtacatgtaaaataaaaagtacatgtaaaataaaatgagtatatggaatgtataaatgtaaaatggataaaggtataaatttataaatgtataaaggtataaatgtactctaatcacaacaataacaatacaccaccaccatgatttgtaaaatgtaaaagcatgcaaaaacatgcaaaaactctatctactactaccactactactaataataatccaaatttatcatcatgcacacaaccaaggttcacaacaaatgatgtaatacacaaccttagtaatacacaaccttacctgccatgtccttttattttttaaccacaatcccccaaattgcacaaaacccaagtaatctaggaataatactctaggactaatatttaaaccccacacctaaataatactctaggaataacattacaattattcaaacaagtaatgtaaccattcaaacacaatggaagactgtaacgtaaatcttaaactaacattatattcttaaaaggaatgtataaaatatcataataaaatatcataaattctcaagtcttaaagttccttataaaataaatccttgtaaggaaatccttactagctgcaccggttgccttaaatctaaatttgttcgtcagttgcatataatcacattttgattcagtagcactttgagtatacttttttgtagtacaattgtacataaacgagcatacatcgtttgtgtctccgatcacgtctagacggtgctcgtccaccgaactgatttcgtgtatgggcttgatgactagcacgtcttcgcaattgggrcggatcgaaatgattcgaacgttgatgatgcgcgaaaacgcaaaggtygacgaaaagtctttgcaatctataaaggagcacttgttgacctgaaagaccaccttggcgggaatcttttgattgtacaccaaaatgttgttaatgtgcaagttgtcgcactcttgcagatagattgcacactcggcatcgtgcattgtacagttttgaatcttgctaaactcgcagctcctccataatgtggctgttttcataggtgcaattgttcgagttttcataggttacattgcacgcgtctatggagcgcagtaggtaatgttgttcaactgcacattggacatgaaactgatggtcaactcgtccaaggctacattttcaaagcgacacgtgtcacaatttcaccgmctctatgytcatgtttttacagtctcggaacgtgagcattccgggcccagtcaccttgctggcattggccgacaagccaggcccacgtctccggtcttgagcaagtgtgtgataaaggcctcgatggcttcggtgtcgtccgtcacaccatcacccacagccttaaagtctcgctttagccacttttcgtgattgatctgaatagactttatcgccgtgttgatggtggatatgcgcgtattgaaacccatctcggtgtctagctttgctgccaaatccctaatattgttcaggttgccgagaaagtctagcctgttgagcttctcctgaacctcgtctcgagagcktacaacctctgccagtttgccttcgtactcgtcgcgttggtgatccagcgcatcggacagggacttgatgcgcttcgccaccgcaccgtcgtccattatccagattggtgtcaatgtactcgtgcagtcggatcgtcaactgatcacccaaaatgctcggatccgtagactctttgagtttattaaacgacttttgcagattgttattctgctcgagtacattggccaaaacctgacaagcgtccacaagctttacgtgcaccgtttgcaactcttgcttcagcttgggtagttcggtcttgatcttttcattgacatctaccgtgaccgtggattgtagttcgtccagtttgacttgtagtttggacatgcgattgttaatgtcaatgtcggcgtgttgcaatatggaaacgtctcgatgcatctgcttgaggtgttcatcgttgtcatcgttggtggtcgactcgatgctatcgcgctttgccaactctcggtgcacttcctcggcgttggcgtacgatgccaactctgacgattccacatagttggccaacctcgagccaaattacaattgtgcacccaggcctaggcacttgtcatcggaactcgagtaccatttgctgtggtagtagagtaccatgagcccgttgactcgatattacacacgcctcgctattgcatcgaaatgatttccctcaagcatatatacgcagttacaactaaacaccaataccgtattaagagtgtgtaccggtcaaacattacagactgtaattttttaaaaatgtttgccaatcgtcagtatagcgttgattctcacgagtcgatagactctttggtcaagtcaaagattgtctcctgcctgaccagggacatgctaaacgagatgttgctcgagcccgatcggttcggtgaagagtctacactagaaaggatcgcaccgtggtgcacctcttttacaagcccgtaatcattgatctcttcaagggcatcatcggttcgaatacgtgcaagtctaccgagttggccaacaccaatgtgcgcattaaacagattcatgtgattccaaacaatggaatcgccttggccgatgggatgccaactctgccgtcgcacattgccgataaactaataagacgatggagactatgaagacgatgacgatgaagacgagtgcaacgaaccgtttagcaccactcgcagaggcggtggttacattaaagataaaggatcctataaagatgccaacgactcgtcggcagttttgaattcaatcgttaccaaggattactatgataattagactgcaagcgcaaagtcataatcagcttgtaaacagaccataatcgtaaaccatccaccgtgaaagtattggcactttgtacacgtgcgagttgcgagcactaaaagtgtaggagttggtgtgttgccattaatgtaagggtaggcgtttgacttgaagagtacttttgtagtgtagggtactagtgtccattaatcgagattcaaacagaataggtattgggatatcaattgaaaaatgttggtatagttttataaacatttattatgtaaataaaatggtattcaaaaaaatcacaatcgttgttggttagttagttgcgtggttagcttagtttacttggtttgtaaaaataaagttgattaaataactaaacattgttggtattgttattgttaaagtaagtaggttagattgtaagagctacaattgttgtagaaagagctaaaattaagtaagtgcctacacgaaaagttttagcaatacacttgcaggatagttgccatcattgaatagaattgttgaaatacagtacagtctaaagatggagatatgtttaggtaggtttgtattttttaaccattaaaaatattatgctaattgagattctaaaaaactaaaacatactaatacaatctatgctaatacaatctatgcatacaatactaatataaaatcattatactactacaaatttgttactagttttgctattagttaattagttaggtactacagcttttggcaccacatttggcatcacaacaatgagttggtaagagttggtaaaaactaattacaaccatcggtatacatttataacaacatttctgtataaaatataaaagagttcatctataaagtttgttaagagttaccccagtttccatcaccnnnnarwkttaaacgtctacaaactctactttctccatgaagatccaccgctgctgggcttgtggtgccaaaagttcatcttgtggtgatacttgtcgacttgtagaacgcacccgatccggaacccgagcttccaccgtagccagaagagccactgctactgccagtgttgtaagcgttgtattctcaaatgtaataaacagcaagtgacactacacttcacaacaaggatgcaatatccactggctgaatcaccgatactgaattatatataaatatccactatggaattagtttgaatttcccgagtaggtagtagtgtttttatataaatgcaaatacacactctcggtatgggattcagaatattttaaaacaactttaaaatatctggtataaatgctaaaggcaggtagtttttgtatacacgaccaaattttggcagatgtttacaaaatgaaggttcacaaccgaatgaccaaacctcgaacagaaccctccttaaatacccatcctatgaaaaaagtttcaaccaacaagcacgcacactatacaataaacgtatttttgataacacatttacgttattgttcgatgttcggtcgcctgtcgcgtttcatccttccaaactgaatccgattgtggactcgttgaatccagactatgaaaatgagcaggatctttcaacacgctcatgtggaacaagatttggctcatgctgggacgagccgaacgcgagggtacgattgatgagaaacacatgtttaaatacaccgactacctggactcggacgttatcgaatccatggccatgttgtcgttcaacattatattggtggactcggatttcaagtggtggcactatatgccgattcawtactttgcatatgtggctctgcacgccagatggccgcatctcttttacctgatcgatttagagtccttcaagggtgaccagagtgcgatgctttacaagtttgaaccgatcgacatgtgcacgtacaccgatgccgagactggtcaacgagtgccgtacgtgttgtgcggtgatgttaaacaggaaagattacgtccgctcatggacgtgagctttaccgatggcgtgaaacgattcgcgctacgacaagatgactcggcacaatcaattggtggagttgagcgatggagtcttgatcaagaaccgagtgctccgattcaaaaacaatcgtagtcgattcgagtttgttaaaatgttacagaaacgagtgtaggtgagtgttagtgtagtgcaatataatgtaatgtactagcatgtaaagaaaaaatctatccataaattctctcttgttttttagaatccaactagtctacttttttgcatccaagcatcccatcctaaacaaccggatcccttggactctaacctctggctctgagaattaatcaaatagatttacagactaattagccataggtagaggacttttgcatttccagaatccattagactcgttagatttagagagagatttcattacatttgaccatttgcttgattagttcaattagtaaatttaccattagtaggcaattgaagcaattgccagtattggtaatttgaatgcattagcatgtaaacatgtagtacactttgtaatccatgattcatgttttttagtatggtacaatgttaaactctcattgtattagaaacgccgtgtctagacttggtgtcaatcaaaaggcctacctacataaacacttcctgtctatacatattgtagctagatccgagggctttctaatgtcaatatctaacggtgaattctccatttcaatttaatacctacttctagttgaatgtaaacatcttttagaaactcggctttttccaataaaaacaccttggctttatacaggctgtaagttgtaagctgttttttagattgaataaattacactgaattgtatgtttacacttgttctttatgattttacgtagtcttgtaattttatacctttacaagtgcacctttataagaaggcttatagttttacgagtacactgcacacttggttaattggctttgtttgcatttattatacgctcagcttttacacttggactgaggctcttgcacttgagttgtgattttgtttacatgtaaaagattgagggtagaaagagtggccgtgttggtaggtttgtattggttgtttgtgatggggatttgtttgtgatggggagttgtttgntaagatgggctgtagaggattagttagagttggattcaacagaaacgagtacacttctactaaactagaatagactttattcagcataaactacaacctattcaaaaaatatcaaacatcaagtaacattaacatcaagtaatatttatatcctttatagcagacctatgtataaagcacatcagtctttgactctacaatattcaaaatgtacatttattaaaaaatatcataaacacatttattcttgttataaatacatttagtattacttactatgaagatatttaccattacatacatttagtagtactatggatacatttagtgtaactcttagtttacagccatttacttgaacattaaacttgaacatcaagtttaaattatctcacaactttatagtattacaacttgtagtattagataccaacattaaactatattgtacacaaaattaaacatttatattgtacatattgtacacttgcattctacacctatattgtacaattatattacaccaattttaccatgtttcaatttactatgtttcaatttactatgtttcaatttactatgcttcaatttattaccctacaataccctacaatacactgcaatatacaacactacaaactgttacaaactaccaccaccccacacacatactaaactatccctatattgcaaaatacaaccatcaaatctagtgtttaacaaccactctgaatctaaaccgagtccactaatatccactaatatctactaatatctactaatgtctacatggtccaacatttaacgtgttcaaaatcaaaatagcaccaccacctaatgtttaacacccatctgctccagctttatcttgacaaagtttatgaaatcgtcaacctccggtgtagacttgaacttgatcaaattcttgacaacattggccgataaagtcatcgtcgtcaatcgtaaacgccggcgatagactctttggcgagtccataaacgtagactcggattgaacctctgcgttaatgtactcgaacaagtcttccatgtcttgtgccagattcaggcacggctctatgcaatcgtccacgttaatcttgtccaaatcgacatccttgcactcttcggtggcatcgaaaccaaacacttcgagcgcgtccaagtcttcggtttgtgtgccttgagtagtcgcgtcaacccctggtagctaatgaattcattgtgaccgatcgacatgcgatgattcggaccgaggccctttatatatcaaactgtacaactttatgaagttgccgatgttttataactaatagggtatgtgtgataaacccaagccgactttaccagttaatggttgttacaatacaaacgcaacatgctgagactattgaactctcaactgggcaagcgaggcgtagtcgacgatgcgctgtccatagattactggaaaaatatccgactctgagcattcccaacgtagacttgaccaacagcgaacagtacctcgtcgagagaataattaacaatagacacttttacaatttatgtattgatggaatgtcttgctcgggaaagagtaccgttataaatcgtctaactaaagactattccgcttgcgcttacaagatcaacagcgagctcgagtgcaaagactacaatttcaattcgactcgattcgtttgaacgattgtacaaaatcacgtctaggatgttttcactgctaacgggtgacgatgacgatttcgatgccgagtttaatttgttggaaatgtcgaatgccaacaatggcaatgatgatgccaataatggtagtagtactggtactactggtactggagagggtaccagttctggcactggatcattcagcacccccatcgccgacaagccttgcatcaaacgatccaaaccgacagaagaggaatggctcgatcgtctagtgtcgttgcagatgaataagcggtaggtgtagattccaagtatactatactaaacaataaaatgtaatattaatgaaataaaatacatgtatactttttgtaaataaattcaatttttttgtagacatgtatgctattggtgttatcatttgtggtattattgtaggtggagcactatataaataaattgccttgtccatttgcatttagttgcattctggttgcagtagaggtactttaagtagatttaaaatttacaagttgaagtaagaatttcttttagtgcacatacacacaggtacaacgttgcactacaaagtagacagcttagcgttcaagtggaaaataaatttacaactcgtagttgtaaaaattaattaacaactctaaaaaagagatagatacttactacaatgcagacaaactgggaagagcaccaatacttgaacacgatcagaagtatcattgaaactggcaatcgccgcatggatcgcagtcgaagcgttttggattcgctcggcttcaccgacagacaagagggcgatctgggaccawtcctgcagatttgcaccaaatggcactaccaccgtgtcactgtttggctcagttttactcgtacgatggcaaattgtcatgcttaatgtatcagaggagtgccgacatgggcctcggtgtaccctttaacattgcaagctactctatgttgacgcacatgattgctcacattaccggcctgaaagcgcacgagttcgtgcacaccattggcgacgctcacgtgtatttaaactactaaaggtgcaactcgaacgggagccgagaccttttcccaagctggagtttgctcgtaaagttgaaaatattgacagttttaagtacgaagattttataataaaaggttacgatccatacccgaagattcccatggttctggctgtttagagagatatatatgatatcacctttatccatcaagttgtactctaacaaacctacctacactaaataatattagggtaaccaacaaacccacctacctacctaaatgatattagggtaaccaacaaacctacaccagagacagtctaaataaaagacaagacattgtaaattgtaaccatttattaaagcaaaatatgtaatgcaatataatacaaaataatgtcatacagtaaagttatagagcatataaaagttgaaagtggttgtacaagaatgtaagtgcagtttannnnntaaataatcctaaataataaccatcttaaacatcttggatggtaaacatcttgtgtgctaaacttcttgtgtgctaaacatcttaaatattaaataataaaaagaaacataatacaaagctaaacattctagacagtaaacagtaaacattaaagtagacagttataacactagacaggcttggaaatcttggacacaaaatgttggccatttattatttattatcaactatagattaattctgacttttagtacwtacnnncyaaacattttagtaaacatttatacattgagattccgtgtgctgatattgatgttgaacattattatagtgcattaaattttattctaaacatttacacgctacatttactacactaatgattacctttttattaaaaattccaaacatttattggcttcatacatacaacctaccattagtgcctattaggtctgcgtttattaccaccactactactactagtggtagactttgttttggagcgaaaacgtttagatggaccaccaccgtacaaacgacccggcacctttttgatcattttaactattggctccagcggtagcggttcaaactttacaagtattccattggccgacttggtggtcagaggattctcggtggtcgtccatttctcgagaggttcagctcgtctatagtttttatggaaccatttattggcttcaaaattacgggttgtaaaagtgtaaaatttaaaatggagctcaaagttggaggatggtttatagagttgtcaaaatgaaaagcatcgtcaaaatgaaaagtatcatttattggactcaatagtgtaacgtttgaatggctccgtgcaatctctggagggagtattgttttcaatattgtcacatttggtgtgcgacgtggagctggctctataatttgaaggggtatttttgtagtagatttagactcggtattggacacatttatagattgatctgtagcagcctttgattcagttgtaaaatctgttacagtgcttgtttgaacagtgccaacacttgttgattgtacgagcacttttagtgtggagagtgcctttagtgtgccgtttgaaattgcttttagggtgctacttccgagtgtagtaaactgtttaagaggtgttgtagttagaggtgttgtagtcagaggcgttgtagttagaggtgtgggtgttgtaagagtagtaggcaaagtagtatgtagagtagtaggcaaagtagtgtgtagagtaggatgtaaagtactaaatttagagttgcaagtaggtttacaaacgacggataaatcctcaagcagagtggataatggaattggctttaaagttgtaggactgagtttaaaggttgtgagatttattgtggtcggtggttgtgtgagaggctgtgtaagaggttgtgtaagtagccgtgttgtagttgcaagtgtagatttggttgttggatgatgtttggttgttggatgcttagttgtggtagctttggttgtaggcatggtgctagtactggttgtatgtttataattgttgtatgtttatttagcagcgtcaacaatggacccagagttggtaatatctctagcaatggcttcaaaggcttcagtgtaggcaaggtaggcaatggttttatagtaggtcttatagtaggcaatggttttatggtagggaatggtttaagagtaggcaacggcttcagtgttggtagcgtatgtttaccgagagtaggcttgggtttcagtgtcgtagtaggtttgggagggttagttgtatgtttaggaggtttggttgtaggtttagttgtaggtctgattgtaggtttagttacatgcttggttgtagccttatgaagagatgttttactaaagatctaagcgtaggcttgatcgtaggcttgatcgtaggcttgagtgtatacttgagagttgtcctaatagtgggtttgattgtagttctaagagtaggtttgactgtagttttaagagtaggtttcagagtaggtttcagagtaggtttaagagtaggcatcgtcggcctgggttttacagtagttttagctctcttcaaggtggtgtaaaatttaggctttactgtagtctgaattctattctttaataatgtggtcgtcttttgcttcattatagatgcagtggtgctagtaattttactacctatagatttggtagtattagtagtagcagtatgaatacgcttgccaaagtttgaatttaaccttaatcgttttattgtccgtatttttagtgtttgtaccaacttggacagttataatggtagatttagcatgtgctttaccagtggatgtattagtctgtttaatgtcagttttagtattgggtagattgccattgatttttggaatagtgtcaactttggatttaaagtttataattggtctagtgtagattggtctagcgttgccagaaagtggtaaggtattgagtctcttaaagtttgaagttgcaacagtcctagtattatttacagcaactctgcgttgaccgtcaaaactatacgtttcctgatctctaacgttcaactgaaacttttcactacgcctactgaaatcgttttgttgcaccaaacgtttggcatctgatcggcctctattgctcctagtatttctagtgttgatgttgctcgtattgttgatgttgtccctagtagtactattaatatawcwacattagcctccccatcaacatcctctttcaaactacgcctgtatcgtctaaagattgcatgttcactgggttgtttgatgctgctagagtttgcaatcaaactactcatactgtttaaccctcccatgccatttaaatttccacctaaactcgaatgcatactcttttgaatatcgtccatgatcaagtttagtgttacttttgtataggtctgcaacaatctactaagacgtcggtgtagctttttaaagttggcctcgctgaaactggaaccggtatccggctttctagacaatctatcaataaaactaggcatcattctgtccataaaatttctatccataaaattggaaccgtttgcgtacagtagctctagataggatgcattgttatgattggtagcgttgaaagtatggttatgatttagtgtggcactattgttattattattaggattatttaaactgaaattaaaactattgttaaaactagtagcagtagagtccaaacctgcaaaagtaccagtttcggatccagtgtgcactacgccaccgttgcgataattgtttgcaataaaactagaatcgacatctttaaacttcaactcgtactcgaacgaatccatcaagagtatccgagtcattagcacgacgattgtaaacagcaccagaatcgcaatgataatgaacagcgacgatacctctctgcgtgcgatccattccttgcgmgtagtagtcctctttagccagtcgacagcagacgccgccaccgacgatgtaagctccggcggtggcacccgagtctcctcctcctccgtttccggagtgtggcactcggtcgtcgtctgattgcattcggtacacacaacgtctatgcactggacttgattgtcgtcgcacgagccaaaagttttaaacttgtaatacgacggaatgcgtttgctacccagattgattcggtgcacattactactactagtgctaccagtactgcactcgtcgtcggaatttaaagttttggcaccagagtccatcctctgagagtgtaataaacttgataaaaaacttggaaaacttgagaaaaaacttgtactaataacaacaaaagcaactactacggtatagtaattaattcaagagagagggtaaaaggaaacccccttcagtctcggcgtaaggctctctgtgaactgattcccacaggcgaccgctggcacttttaaagcgcggcaatgttaggtattttttagtcacacaggatgcactactaatactaacaataacaagtccaggatgtgatcagttgcagattacaaagagcacacgcgcgccgaacggttgctactagtgtattgaaggcgcgcgcgtgtctaaaacttggtaatcaaacaagtggccaacttgatcaaagcagcactatgaccggtttgcggggcgcgaccgtcagcacccttggtcgtgaacaaactgaaattcagaacactgttgtacatcactgtgtaagaattttattaaaagtcttgcatttaattaatcaactctgtttatgtaatgcagctacaatagcgtattgaaagtgtctaaaagtgcacattattgatgaatacacgatggcggtcgcattgtctagaaaacgaaagcgacaccaactcaaggatttaaacacatatttggaagtgaacgagccacgagtcgaaccgcagtcgtgcacgtacttttatgtaggcttcaacaagtaccaaattgtgcaacaaggcaacgcattctcatatattgacacatttagtgtgcggtatacttttgtacaataaaattctaatgagcaacttggtcgacgacgcaccaatcgcagagagcaagtttatcggcaccctgggcagctacacgggtacgtgccaaatggacgatatcgagtttaaggatcgtctcaccaaaaagaagcaaacctctatactgcacaaactgtttatattggccgatcacgcagttacccactttttggaaagctttatcacgcactcgggattcggcaccaagaatgtgcaaacactgcactcttcgttgaaaattataggcaccgtttcgggtgttaatggtccgggattaatgggatccaccggaggattgtacggaaacggtctgctggccaacgatcacgttaccttgaattatgatgatggtaaattgttgttgtattaaagcaattgtataatttgaagaggaggcggagtagtctataattgcactagtaatttttagtaatttcagtaattggcgtttgatgaattatgcatgtggaaatacattgtaggagtctaacggtgcatagtctgatgtagtataatagtctacctgtagccgtgtatttgtatagaacaagtatcaagtatcaagtatcaagtatcaagtatcaagttttagtttcaccagttggatttgtactgttcaactttttgtattttttaaacctattgtatatgtattgtatagttgtttcttctattaataaaactaaataataaaaataaaatacaataccccaaaccacccactttagtttaactctacaaacaattccataatccatataatttcatttgtgctccagttggcactctgtgtgatgaccggtactgtataatactgcagcgttaaactactcctaccactactactggttgttgcggatactactactaggtactactactactacctattattattaaaactacaaannnnnnnnnnnnncaaaaaacaaacacaaacaaaaaacagaaatacaactaaagcctaaaactagtatacctacatcatcatccttctctcgaaaactttaacaattccaagtttatcatttttagttttattaaaacttggaatgtctgcatgagactgtataaaactatataaaactgtacaaacctgtataaggctatataaaattatagctataaaaaagtccacaccaaatgcaaaattaaatgctaagcaagtacaaaaattctagaaaaatgctagtttataaagtacctacaagagtcaaggttaacatatataataatatagcacatatgcacacataatatccttggtagtaaaacttttctctcaaaacaaaaggccatgtgtgtatgtgtataggttgatttttatttttatttcagtctttaatacgagtacaattagtagcagtagaatgaacacaatttggtattgggtgctaggaaaacaataaatgacaatagatgaaaaggattacaaagattacaaagcttaaagactacaaatcaaacttaaactacaacgccgactctccagattcatcattggtaaacttgataaatacatttaccaattcatttgttttgggatcgtactcgtgctgttgtttcaggtcacttatgtaatcgacaatcttttcactcatcgtaatcgaacagtgcttgccaatttcgtgctttaatctgcgcacatttatacggccgccctgtcggtactcaatctgaaatatggattttaaatcactccaagtgtcgtcgtcctttttgtacgaagcgctcttgttgctattgttggcgttgtttgtatagtgcccggtgccgcctatgccatagcacgaaccctcttcgtcttcgaaacctataccaatgtagcgcttcaagtgttcattgtaaaactgtttaaactgcatcctaaactcggacatgtacttggatagcgatatagtcttgttgtaggccgagttgtactcaatcagcttgagactgacattggccatgaggtcctcttcgttgatgctgggcaccgaggtggacgacatggccacattggattgagacggtgaaatcactttaatgttgcacatgtccaacaccttgtacagatagttgtttttcaacataaactcgtacaacagtttggtagagactcggttgatctataccatagtcgttgcgatgctgtctaaagtagacgtacagcagattggagaggagcggtgccatcttggacacttccatttgttactgatcgagctcagttcgttgattatggaaatgtacttggtcttcaagtgtatggcattgggcgagggaccggatgactttaattgcatcgtcgttgcacatttcagtgtgcaagttgagcagtgtagttttaccacacctgggactgccgtagtaaatattcatataagagctctttgtagtgtttgaattcgggtcgacagtgacgaaacacgtacgaccatacacgatcccataggtttagtttgttcttaaagtgagcatcgtcttcggtgagattagtgtatatttgcatcaaacgatcaacctcatcctgacggcccatgttgataaagttgaaggtggcatcgtccgaatctacaatggttggcatcatyatymycnnnatcctcatcctcacccattccctcatagtcctcagattctccaaaaccagtcatggtaatgtcggtgttgatgtcaaacgacaagcgttcgtagcactctttgaccgtgtcgtacgagagctcagagtcgtaggcctccagatcatacgagccaatgccatggtgtggccctttagtttggccaacagtgggtgcacgaaaaagtagcaacgctcgttgcgcatagagtcaccctccatgaaatgaaagatggtcaaccatacaagagacgttgattctttaggaatgtatccaacaaacgatagtagtcatcgtacgtctttagcaattgaaagttcataatgtttaaatctttggatccgctcagagtgtgggcacagaagcgcttctccatgttaaagtagacaaayggagwcttggkcagawagsttccggkgmttgtgtamwakwctccgtgwctcstgtwgataamgtaggtktagtaggccctgttctctgcgttcggatcatcgcactgcgccaagtacaaactctcggccaggtagcgattgagcgagacgagcgcgttacggtaatcttcatcggtttggcctcgtactcgagcagcggtcgactgttggcacccatcgtggtgcgttgctgataccaataaaaacagtaggcgtatttgtagaatggttacaagtattaggattattaggaacaattggtaaaacattgagatttacatcaataagagtggtagtagcatcagcagcagtagcaacaggaacactagtagtaataacatcagtaacagtagcattattgttattattttttaatattagtagtaaaagtagtagaggtagtagtagcagtagttgtagcatcactagcagctcttttagatttagacttgggtttggggctgcggccaagtgctcgttgtcgctgcaacccggtggaatgcgcatcgtgtaaacgttgccgtcgctctttgccgagtacggtaacggcaccttgtcaatcttgtcaatcttgtacacgtccgtgtactcacatataccgagtccgggwaagckagcgtccaakactcgtgtaargtctcggtacatcattgtcagttgggtaatgggaatctcttcgatgccgtcatcgtccgagggcttcaagtctagatcgaaacaaatcttaaactgataattgtggctcattggtatggccagagtgtggccagactcttcaaagtagtcgcgcaacgtgtccagtcggagggcataatcgtacaggcgaaccgaaaaagagtcagtctcctcggcccgattgcactggaggaaccttgtctgatttctggcaatatcttgatgcgctattgtagttgtgatcgtagtctatttgggactcttgcaaaatcactgtaggcgtaggttcatagacaagagaagagtaactatcggtaaatactttgacaagtaccaagtgtttatagtattaggtattgcgataattgcaatagtctatacgttcagtttgttaaaaacatcaaatctcggcaagactatgggctcactcaccgatgaggccaccgactctacaaagtttaacgcatccttctttgagatttacgacaaatccaccgacgactactgcgatcgtctaattctggtgcaaccgttcaattggataattgtggccaaaggtggccagatgtacgccctgaccgatgtgcagcacaagtgtccgccgaccaccacccgacaccaccttctacaccaccgcctcctcgtacaccgacgccaccttctacaccgacgccacctatcgcagccacgatccatctaaaccgcccaagtttggaccaccaccgaatccagagattgactctttggtttacaaaacgtattagtttatggagtggtttgtgttttagtttccaattctaatttactggccttaatttctagttttgtatccattttgcatgccttgtataccactttatgtaccactttatgtaccacttttgtgttttttgaaatgtctttgtattaacaaatttaatagccattataatatttcaccttttttaatcaaaacccaaataagagtacccaaaaaaataactagtctagtttgtataatcgtttattagagagattcaaagagtatgtatacagagtttatgagattcaaagagtatgtatacagagtttatgagatttaaagagtacatagacagaggtgtccaagattaaagagcacgtaggccgagttacatagattaaaagagtatatagttacagagtattgaattagagtttcagagtattgctatttcagagtagagaacatgtatatcgagatcctttcataatacaggtttgctttgagattcataagagaggtttgctttgagattcataagagattcataatacaggttattttacaaacacaagatgttcacacaccctatgccatcgaaaacaaatgagtaaccatctgggactctttatagtcaaactcacgatcagtcaaaacattgagcagcttgggatcgtagattcttcttgtctgcattgcacttgatgcaaatattgctgacggtaatctcttcgtcgccggacctggtctgttgctctatagtcgtcaatggtgggaatctcatcgggcctcttttccagaaagcagcacagactatagtgattgtcgtacactttgccggtgtgagtctcacgataggtcatgcacaacttttcaaactttacacgagagccctccttttcgattcgagtcttgaatcgttcagtgggcaggttaatctcattggtttcgcgttccttttgtagagactcgtgaatcgctacaacactgggatccgatgtcgtaaacgagtacagcactgtagagttgttagtattcaaagagagtctaatgttgacaatcttaaaatatgcaggtagaggttgataatgcaattgacgagtatgatgcttaggttgtggattattgtagtgttagtttttactagtggatgagtttgtgatgtcgttagtttatatttgtactagtagttttgtaaaattatgtgtagtagatttgtaatgattgtttgtatttttttttccattttttcaccaaccttcaatgctagcatactcgcaacactcgagtgtggcctcagaggtaggctctcaaacgcctaccgtgcaaacaatagcaagagtacgggttgcgtgaattttcaacatttgcgtgtgttttgcgcattttcatttttatatattggggttatattgtggtgcaagtattatgcggacgggctcatttgaccgtctccgtgatgggtgtgcattttgcacggtacgcaaaactacactctgtgacatgccgtaatgtgtaaaatgcatcctattgtgaaccccttcggttcaagttttagttcatactttttaaactcgtaattttaakttcacgaaattgggtgcaatttcacgtacatttggtgtgtttgctctgtaaattacgttaggcgttggctaatctggcttaaaacttggtcagaaatcatcaaatatcaccgagtgtgcagatggctcattttgagcactttgcgcactttggtggtaaaatcgacggatactatactataatatatattatatatataggtactgggcgccgagttctatttttttcaactcgtttttgttatatttttttaaactcgattactgaattttaaataatactaaaaaatgtaaatgtttatatgtatttatttggtagaataatggtggttacaagtatggcttacagttaccagtatggcttacggttacaagtatgtcttacggctacatctacaaacatttcttacgctacaagtatacgcacatggaacaacatacaatagcatggaacaacatacatcaacatacaacaacaaacccccgtaaaatctaaatctatcccttgagcttaaacacacacccaatcataagatccaactcgtgcatggcctcctccacttcggcacgcgtagacggagtcagccgatcggtgcgtcccatgccgttcatgagcttcacatcaaaggtgggaaacttgaacttgaactctttgttgcgataaatgacaatgagtccgtctcgcttaaacttggtggttgcgttcacgtctatggactcttgcaccaggatgcgtttgcagccatcgccaaagtttacatactgctgttgacgattgaacgtggacagaaacttgagcacctcttcgggctcgggcatgaacagytgaccgccgagacgcactcccaacacgtctgtgattatcactgtggttagaggattgcgattcctttctgccgttggtgcacatgttctccaattgaaagtacaggttgggtacagtgttgaagattgacgaattaaactgtataaacttgatgttgtcatcctggtagaggaccttgttgggctcggtgcacaccagtttacacttgaagccatcgtactttctcctctatcgatacggtacgacacatgggaatcacaatcggtgtggccatcgtgccgctcaggtacaagtgtcgggatttggagattacgtgtttgcgctgagatgtggtgccggtgactcgagtgttgtccttaaagtacatgacccacacttcacgatgtggcaagtctacgcgtgcaatgttctttttgatgcactcgccaatgtgagtggcgactgagtgcaaagtaggtttcgtactccatctcacaattggggttgttctcggtcatggatgcaatgtgtgccagagtcttttgattggtgatgttgcttttgagtttgattctgagtttgattctgagtttgattctgagtggatttggaatcctgagtctgaggttgttgagctagactcggcttggactctttgggtggagtctgcttttgcttgggctctttacaatcctttttaaccatctcggtattggatgcactcttgttctttacacttgatgcagagtgcgcactcttggcattattattggactcgatgcccgagcttgtactttttgtgtttgaatttaaactgtttgaatttaaacttgaactctttacactgttggcactctgtgtgctaatggtgctctttccactttgcacactctgtccactaatggcagtcttactaccaatactgctggtagcactctttgcgctaatgttgctcttggtactctttgcactaatgttacttttggtgctctttgcactaccaccactaccactactacctacactctttacactgccactgctgacactactctttggactagcgctaccggcgcctacactcttttcattgctrctctttacacttgtactagttgcactattcgggctcccatcctgtggactctttacgccatcctgtgtactcgttggactctttaaaccggcactctttgcactagattcaatcgcactcttgattagtgcattcttttgatttgtactcttttgattagtactcttttgatgaggtgatgtactcttttggggtgtactcttttgtgcagtactcttttgtacactactcttgtgtataccactcttttgtaaagtactcttttgaatcgcgatactctttggattcagtaaactcttttgacttggaggattcagagcagaaccggtactctttaaagtgctactattggtactctttgaactcggctgcacaggcttgggaatctccgagtcctcatcggtggacgattgagtgctatcgaatcgtttaccgaacccgttgccatcgccgaatcctaccgagttgaaaaggatgcacatctgcgtacgcatcctccgaactcgatgacattgaaaagttggcagacctcttcatgatcgctgccggaagtatactaaaaaataactagacgacctactgaattaaatactgtttctaaaccctgaatacgtgcgtgtagtatcacgtacaatgcaataataaatgtgtacaatgataatttcaaaacatgtaaactacatttgtttagtaggtgtttggttttgtatcctcaagataagactggtagttataagtgtattgtacaawtggagsgcaaggtcgagtgtaatcamaactcataacgmgwtgckamaaaaatmscctktatygwtggaattgaaaagttacagagtgcaatggtgcatttttagtctaaggattattacaagagtttactctaaatctatactctaaactaaactctaaaccacactttgttcaatcttggccctctttgcagcagattccccatcgagtccatcgtcctctgccagaacagcctttacgggacgagggtgagtgcgcaacaacttcttgtactcgtcatagttggggtttccgcgatcgattccaccaaagtcaccgatgcccttaaagtcacgctgtaccagttcaaagttgccaacaatcaccttgggtatgaatccgttgagcgatagcgagttggcggacggagtctttctatagtagttgcttccgatcaattgatcaccgttcaggatggatctttgcctagagaacggcaacactccactgggaatcttgtccagtgttttacagttgctaatcttccacaggttacgatcaaaggtggagagatcgcgacgacagcccatstgcacgggacgcaactctttggccaccttgggtgcatcggccggcttggtgtgtgcactcattgcggtacgatcaaccattatgagtttaatcttgagatcgatgctgaggtgcgagtcttgtttctcggcatcgttcaagtctctgagtttggcgatgacaacaccaaactcgccggcattgtgagtgtccaatgcgaatggagacacgatgattggggcatcgtcggtcgcctggtctgtgatcacgatgcacgtactcrgcaccgtgatgaacacaccggacaatamgackccgcactggtagagtttcatcgagtctacaaacgcagaaggcactcgcaaagtcagagtatcgctatccttggccgtcgctgcactccgagtctacgttcaacagagtcttgaaagtgcaagaagccattttttattacaagtgtttgagtagtctcagttattaaagcaaagctttacaatgctcgaatctatagaatatcaccgccttttaagggcaataccgtattatcgatatgtttacgtttgaatgttatataaaacactttgcgcgtacggtgtcgatacagtctggcattcatactctttactaccggtacctacatttaccaaccatgaagcgtagtggagtacacaccattgaaaatgtcaattttggcatgtttaaacgtcctcgtacgatcaagggtgactttgagacggattggtgtgtgctcaaatttaggacctataaatcggtggcgtgcaatgacttggatcgaaactatatacagtacaagagtcaggtgcactgcataatcaacgagtttaaaaaggaactctttctcaacaaggtcattgaagagtacaccgactatgcactcagccgggctctggacgattcatcgacgttggccaagctcaagggtggacaaacaatggcgtttgcgcacagtgcaagatgacccccgaggaggccgaggcatcgtttgtgtctctcaaagagtgcctgtacgttaatttacgcactctggactcgtacaagcgactcgaagccgaaatggaacacaatgccattcggattcaagaggattgtaaaaagattaaactctctcaggaggacgaatcgattgcacaaaagtacacggatgacattcgtgcgtacatgagacactttaagaatcgcactctgctcgagtacctgtgcaatcgcgagtgtaggagttttttgatgatccactatcgagccgagttggactacattaaaacaatccccagcctgaggaggtggatgctgacaagggcaagcgcaacaaacccaacaagatggaccatcgcatcagacaaagctacaagcacatgatttactattcaaagaagaaccgatgaactctctgtacatgcacacgcagatttggtcgagcttcatgaacggtctaaacattaccaagaatgaaaagacctttaaagagtacatgaaggcgtacatgcatcgcagatcgttggtcaaaaacatttaccaaactctgaccgatatgaatatggtgccggcgctatagttcggtaaagatttgcatcaaacgcggcgtgcacatgctctcggtgaacggatcctactatcgagagtttagggatctctaccggcaacttttacaaaaagacgatcgattactatgtacccgctagtgaggtgtaagccaatgtgtttgcgtatgcatgtattgtattgtattgtattgttaattcatgtaaacctgatgttgctttattaaataaatccacttgaacacaatgagtttagtcttttttcagatgatgtattaggtacaatacggtattggtatttgtctttgggtaattattaaagccttagctagtttagcttgaaaatgagtctgaatcctagaatgattgtcaaaagaaacggttcagttgaacgattcgatccgatcgagtctcgacattggagctggacactctgttgtccgaaacttgcgcctccatgtccaccgcgcatccggaccattcgatgctcgctgctcgcatagccatgcaggcgctacacaaacgtactcgttccaagttttccactatgcctcttgctatctgctcgaactcaaagaggacagcatcggtggcgttatggacacgctaaaggacgcggccaccatttctaaacggccaggcgctatagccgtctacttggaaccttggcacgcggacgtttttgactttatcgagatgcgcraaaactctggctttgaagaggcacgagccagggactgtcaatctacccaagtttgtagagggtagagtgtttaatctcaacctattggcaaagacggtacgtctggtgactaggaatctaaacaagattatcgacaatgcactctatcccattccctcggcggccaagtcaaactttaagcaccgacccatcggtataggagtgcaaggttacgcagacgctctggccatgatgggtatagcctacgaggactcgatgcagccgaccagtcgtggagagttgcacttcgaccgatactcggtgcacagccaaaagtgtgactggtcatcgttgcgcaaagacattgggcaccgatgcccacggctaccacttctcaagtgtttggcaatgctgaatctttkgmaccrttcacktcaawcatgtaccagmgacgcacccagtctggagagtttcaattgaccaacgtgcccttggttatctgtacgttgccgagcccacctacagtcgtatgtcttcgatacacttttatgtatggaacaagggcctcaagacgggcatgtattacgtttatgcaacagattgcagagaatccaaccaaggcgccactaaaggctaaaattgatgcagcaaattctgttgagaatttaagtaaacgcaaagagccttcctttgagttggtcgatagtgatgctaaaaagatttgcatggatattgatgataaatcaaaggatgaatcaatagagttgaatggacgcaatcaaatggtttgttttgatgatgtgtgtacgtcgtgttcttgttagaaaggttttgtaatttgtagagttggtttatatggttgtagagtttagtagtttaaaaaacagttatgtttagtttaaaaaatatacataaattgtttagttgatggatatacatacagggttaattataatgtagatgattgtacaagtggtttgtgtacatgtagtacttgtaaggtattttataaggcattctataaggatgtaaacatttaaacaatctatgcttgtaataaattgtttataatgaaaactaaaatacttgttgttttttagactctaattcaattcaattcaattcaatacaattcaatacaatacacacagctccccatcaaaacccagtcacaatataggtaatcttgctgaccacgttcgatagagcacaagcatcgtgaaacttttcaatcttggatcmcaacacttgactcttgttggtgtctagaattataacgttttatggttttgattwgttwcttgatggtcgtgcccagrgtacggtagccmttgttggatgratwcattmwaatgtwcmtgrmcgacggggtgtcggtccacttgcgtgcatgtcttagcgcaatagtagcgatgctcttcacgttgtccggcttgacaaactctaggtccataggcatgatgattaatggcacatttcataatggcaaccttggactattgtaataacacattgtcactatcgtgctaacggaaacgtttggtgccatgaataaagatgtcgtaaatgccaggagtcatctgtacaacaacgaaggcaacagtctcagaccgtactactatctgtttgagcgcagcgatgaacgcggtctctttaggttaaggttaaactacaaatatcacaagattcgtcaaaagcattacataaggttcaccaaacagagccgaggcttcagcaacgagtacattagtcaatccaacttaatgtccctattcaagattgccatgtttgaatttctaggtagatacattgtaaacgtaggcagcatagtttcaatcaatcgtaaacgcttacgccatcatagcaatgaattacccaatagttagaatggttcaaatcaccaatgagatattacgggtatacaatctaattagattatagagtatctaaacgcgtcaataacgcccactttgtacgatctagagtttacaataggtctgatgcgatggagaaaaagcaattaagcctacaagagtacgacactgagcagccaactcacgatctgccacaggtgcacatttacgctgcagtgtcgtgcaaccacaccatagactcgatgttcaactttctcttcaacaacatgatcaaggtggagaaaaactttacggtcgcactcaaggcgttcatcaagaatatcaacaatttgattaaacagtttttgtttgtgaaaaagagtacgggtagtagtagtagcagcagtagcgctaatgctaaaaatgccaacaatagtgcagtcataaagtcggcagtgtatccgtgccatgttaccaattcgtgcaagtttaaacagatgcgtaccaagtttgaatcgtacgatcacaccagtgtacatgctgcactgtgtacagccgacgccacactagttggtaaattttccaatttggaatatctaattctgttgaatgaaacccggacggtatttgaagaggtgcgaaatgtgttgcatgtattggattgagagaaagcgagtaccgtttaatgcaggttttgtgtaagnggttnntgtannagnttaatgtagcaggatgttttatgtaggcagaaggttttatggaatagaggttaagtctatttaggaggtatctctgtatagcatccgatactaaaggtggattaatgtcaagaatctaatgtcgagaccctcaacttgctgtatgtatgggtgtctgtatgatgtctgtatggatgtatggatttatgtgtatatgtatttttgcatgtaaataaaggagttttaaataaaagattgtaatatagagtcaagtagattttaatrtaatagtgtagtttaatacaattggttgttataatctaacaagtaataatgtaattgtataaatcctagttttagttttttaaacactacatttgattatattttattaaacaacatttggatattaaaaaataagaatgaacattacaagaatataaaactgtagaatataaaactacaaaatataaaactatagaatataaacctatagaatacaaaactaaagaatataaaactatagctaccataacactaaacaaccactcctcctcctcaatcatccatcccaacattgacatcatcatcgtactcgtcctctccgtcaccgtccaagtttccatccccggctccgtccttgtttgacacttgcattgtcatccgaataatgttgctgttcattgtagtcggcatcttcaacctcagacttgatgtccttttcagttttaatctcagacttgggctcacactttgtcacatccgactcgtcaatctcagagcctgaacctcctctgtccaactccgagtccaaattcggaatccgagtctagatccaccggggcctcgttgctcttggatcgtttaggtttgtgttggtggtcatcttccagtttgcgtttaatgctaccggtactgttgcttctgactacatcctttttagcatcctttgttgttttacactctttgtgtccatccttcaattgcttgtgtttatccttaccaaacaatacagcacccttactcttggtctttttgcacttttcaatcaatgcaaaggcaccctcctcgtctcggcctttatctttgaaaaactcgtgcaccgtctcgggagcctccatatagtactctttgcgctcgggctgaatctcggccaaatgggtaaactttgtggccgccgccttgatggccagcataaacttggaggaatcgttaaagctgacgcactcaaactcttcgcccaattgacgttcgttttctcggtcgtcgtcgcaatcggtcagcatgccaatattggtggtgtgttcatggcctcgtgcacgcccacaaacatgcgatacttsggcgaatacttkaccggcwagtggmccacatggtacacgaccagatagactacgcgcaactctgcctctggactgtggtggtcgttcaaaaagtctacgatccgctccagtgaaacggccggtgcaatcattatcatctccttgacgttgagcggacagataaagttggacgagtcccgtggcagtttgagtgcattcgagtttttcacaccgtgattaatgtgtcgctttaccgtactgatgagtttgtcgatcatcgacactcggtggccctccaccgacaggtaggcagtcttgaactcgtcgtctttgaggatagcgtgtaaaacagattgcccgacaccagagtgcccagcttggaagagttttgcggtagagtgctccatttcacagtgtgttcattgtcagtgattgcgttcaccgggcttagacgatttatgagtgcaaagatttcctcatcggtattgtcggccacgtggccgcatcgcagattgttggtgatgaaggccggtaaaatcttgatgcctccgttcaaaacaaaggctcccagctgatgcttaaagtccacattgggtctaatcatcatgtcaatcttggagccaatcattatcggcaagaccttgtgcttgacgatcacttgattgttgctacagtgcaattggatgcatgcagcataagatttgttgtactttaacaagagccgaatcacatcttcgccgtctacgcgcttagactcttcgtagacgtactcgttgtagcaaggacaattgtagattatcaatttgtccatttttaggttgtactcgtcaacaatggtttttgcgtaaaaatccatgtttgctgctgaacgcaaatcgctcaattctagatttgccaacactcgcatctttgcctacagccgaaacggatccatagagatgagcatgacactgatggttcgtcttaggtgtgtgtgtttgtgtttgtggttgtttgtatttgattgtatttatttgtagcttagagtagaatatcaaatattattatagaatcgatggcattttcaatagtatagaaatgcaatagtgtagagtatccaatagtgtagaatatccaagtaaaagtttatttttaaccaattcaaactcttggtcaatcaaaactcgtagtcaacatccaaacctcttattccagtatccaaaaccctctcattccacattcaatcaaaacctcacattcaatcaaaacctcacattcaataaaaaataattgccgcatgtaggaatgtaaacttgattgcagtatgtagcacaggaagtgtactgattgaaaaactttatagcttaaccttaatcttgatacatagatggatgagaaaagatgcaatatctactgcctgcactcttggcactcgtaatgtgtcttgtattttacttaaatccgtcgatttgggtattgcaatttcaaacacggaaaacttgatgtgcaagggcgaccccagtgccgtcatcaactaccaccattaccgtttgcataaatacttgacggatacgtaaaagtcccacatagtttagaaatttgcataaatgtgtaaatttacaatttaattgccatgctagaaatccaatctaaattttagactttgtatgattataggtgcacaacttcctgtaatgttggttagcgatggttattttttcaactttgtaaaaaatgaagggaccatctaggcttattttttaatttctctaggctattattaattcacagaaaccggttgaataaaacattgaaattaaccactttgtgcggtttttagtttgttttttactaaaaaacacgaaaatgtcagtttagtttattgaatttacttgaaatcctacttcttgattaaaaaaatcaaacaaatacacaaatacttgtaaatcattacattattacaaagcacacacactaatcatttccaagatttaacgatcttggtcaacaatagatgaccattagtcacagtctttgagtcatttgacccaaacatcgttaaatagcacgtcttcgatcgtctttgtcttaaattcaaatgaatttttgcacttttcaaagattttcaaaaatgccatgaaattcatgtgcgccaaaatttcttggcgactaagaacacccaaagtggtggtgtcttgcactacaaatgcaatattcttcttgtttgtattcaaaaaagtcgtcaacagttwaccctccagtcggattgcgttgatttttctacctccactgggctttgtactgagtaccgtccgttgattcgggccctttgtctgcttctatcaatgccacctcatcgtatcgtttcagttccgaatgcggaaccagttcaccagtgttttgattgataaaactcatagtttgtaggtttttattaatgtttacactacacacactgcaccgactgatgtgtgcgcatactagtgagtgtaagtttagcgtacgtataggttggatctctgttttttgatgatattggcggtcgtggtactgctcttgttgacggtgacatttataagatgcgtcaacctaatggttcgattgcacattttgatcctgatgagctcgaacgagagctatctcgagtaccagactgcaactgttactggtgcaaatgtcgccgctaccccaccgacgccgccgccgacgccaagggacgagatggagctgctcaaggagtggagtttatcgtaaacggttagtgttttaatgatgtttttccgaatgtcagtcatggctcaaaagtaggtcaaggtcaagaaattgggtcagtgaactgtatagtacatttagcaagtgtacacgtatggaatgtagggtttttttggttttatttagacatggcattcaattttatgcacttgtatagattgggatttattggcaatttcaaatggttttatagaggaagttgcgtgtaaggttgtgtgtaggattgtgggggtataggattgtgagtataggcttgtatgtaggattgagtttaggattgccttttatattttcatccttttatccaaaagtattgtgtgtttttatcaagtaaagtacaagcttgtacaaagtactaacaattgaattctctctcacgcaggcaccaaacttgacggtaccggagtggtctgtccctgtacgatggatcaaaacgcttggattggccaatggagcaacaacagcaacagcaacagcaatccatcaagaacccgactgagccgcctctaccgtcttcggccagctactactattactattattactactactatctgaaccagcactacaataatggcaccctaccattctgtggagatgatgtcaattttaaaaatttgacaacaactgcaacggctaccagtggtggtaccaatacaagcaccaatatcaacactaatcctactacaactaacctttataatggatccgtttctttcaccgactccacgcaggagtgtcgtaaacaagattccctgtatgcaactcgtaaaggatgtcataaatatgaaatatgggcctcgcgaaggctaacattaacaacactggcaacatcttcttctcctccttttatgcagacatggctatgaattttggaccaagaatagatttagatttcatgtttttagaatgtatgtagatgcaatgtatgtagatgcatgcagatgcatacattttttttaacattttataaacttaacattttacattttttacacattttataacatggtggtgggatcggtagctttaggttttggtggtggattttgattgtttattcatcagggatttttatagattttttcttagatttagttgctctaggactcggtctaggactcggtctctagagtttttaaacatttaatcattgtggtggtggcctaggaataaatgcataatcagtggcgtggtggtactggattacaacattattattacatttattttttagttgtctggttataacatttgcaatattattttataacatttgcaatattattttataatacagttgaaatcatataggttagaggtgtaaggttatatataaaattgaaaaatcttggtatagggatttggtactttttccatagtaataattgaacatgcatgtgtgttttacataatatttaaaagcaacacagatttaattgaaccatagggtgtaagattgtaatatgaaacattcatacagatgtgtcttgcttggatttgtagatggtttttttacacgagaccgtttatccaacatgtatacacaataatcatacacatttgtacaagtatgtgatttttctgtttaatgataatttaggctgtagaatcatcgtaagaagtaaaacttgacacgaacaattgtacacacacacaagacgattgttttttaatataaatactagagcaaagaggttttctcaagtacagtctagctactactactatctctaaattgtagtctaaaaaatagaatctttggcagttttaaactctttggcacctttagcatctttattagactcttggcttgtgtttctcaatttaggtttaattgccggtttatttacacatttagttttattcaaacatttagagttatttaaacattcaagtttttattaaagctctaacgtcgattttaggtttaaacggcagcaacagctctctctctgtgtaatgttttttattcagcatagtggtatcaatatttataatttataattttttatatataatttgtacaatatttttatatataatttgtacaatatttttatatatacatatcagtatttaaatgatgtaatttttgagccccagaatgtgtttcttttttgataggtgatgatgggatacagtaggtgtataagaaataccattacatgtttttataagaatagttgagagttagtgttaggttagtgcttaggaacttgagcttgaattgaaccaggatatactagcacggtcatggaaactaatattgctgcttaaggtgtaattgtaaggtttagttgcaaggtttagatataaggtgtgtgtgcatgtatatcggtagagtatatttggtcgcataattttatatattcaaatcaatgttcaacttactttcaatcaacttgctttcaatcaacattcaacgcatcattcacgccaatagtcattttaacagtaaacctcaaaacccatcaaaatcatcagacccatcaaagtcaccaggcatcaaatcaaaattcctccatgaaagatggcagttttatatcccaccgagggtgtgctaatgttgaattttacgacatcgtaagagtttaaactaacagtwtgatttaatgtaatatgccagtaatatgccacaagttgtaatgtgatacaagtagcagtactggtagtttacttattgatggttataagatgattatttatgttgtatcataatgggctaaagttaattagttttcaccaagacctgtaagcttgaaccgtaataaatgcaaaccttacaagccatataaaatttacatttaacaatttatttagttgaaatttacatttacatacaatttatttagtgctataactatttttggcatacattacgagctgtgattatctgtagactgcacgcatcctttaatgtgtattattttgtagtgcttagcaataaatggtagatttctcgtaaaattgtacaataaaaagcattccagattgctgtctagattagctttttaattgtacactttaccactttgatgcatacatttggtttaacatttcaatttcaatttttttaatgttcaatttagtatgtaattgtgtattgtaaagtgttgattaatacaagtccaagtgcaaaggttcaagtgtataaagcgaaagaaggtgcatttcatataccaacaggaacactggtatacctatagacttttttaaaagcaagtggtttcagtgcgagtgtgtacatgtggacatttaccatggagtgtgttggaatcgttgatattagtacatgtatttggcagtagtttttncgtcttgacaatccccctatagtgttgtaagagtgtgatttagaattactacatgtatagatggatagtatattacatagttgtatgttagcgtatgttagcatggataggcatggatagttttagtttccgaattgtatttcctcttagtttttaatkttgacatagatttccaattagtaagtaatttgtaaagtagagcaacacggtaggttaatgttgattttttcaatagtattggcagtgggtaggtttaacgggtggggtgtctttgtcgtatgggtcgagggttatctatgtttatatgtataagtttaaaggtttagttttggttcattttataagatttagcttgtgtaagttttacaggtaaaataagtggaatagtgtaagcaccagcataagaagtagtgtcgatttatatagtgtttccatttagtatgcaacttgtaatttgtagcttttgtacaatttgtaaattttgtacaatttgtaaaatgtagcatagtttttgaatctgcgtattaggtcaaccttggattgctatttatttatattgtaaggtttattataattgtatagaatcgtgtatttagcatagtagtagtagtagtattagtagcagtagtagtattagtagcattagtagtattggtaagtagttccccaatctatcccaacggtatttattcggcagtagttgcattggcatctagtagcattagttgtactagtaggagttgtacgagcactagtagttagtagtaggtaattcccacgcatccgagtattgagagagcccagaatacatctatacttagcagcaataagagaataaattgcaacaatcagatgcaccaataatctgaaccatcagaaataataatcaagcataacaagtactagtttaagccttgtaaaaagtgtagctaagcagtaaacacttgactgtgataataaatgttggtataagcattctaaagttactgtttaggtttaaggaggcttagaggtagggaggtgaataggtaggtagtaggtagtaggtagagcgacgggtgtttagtttaagtttgggttaggttaaaatttacactttatagatttgcacatagtatagtttgatttacacataatatagtttctaaaaaatacaaaatccaataaaaagcataaaatgtaagaaaccccaaaaacaatacaaaatccttgaaaatgcacataaaaattgtaaaagcataaaacacaaaaacattcaaatgagaggtcaattgcacatgtagagttaagcgcatcgttttgttttattaagcatagcatgtagtggcacacacttttgttgtaaaatgtaaaggcggtaatacaacaacacaataaattgatgtaatgcatcatagcaccctggactcttatattgaaacttgcgattacatatcgctggatacggtcgtcttgttgatgaccaacaaagactttaccctaagcacgatttcatacatcacgaagtgacaccgttcgaggtgagagcctacctcaggcgcaaacagtgcgtaaacgttagacgtacgacctgaaacggtggttcgatacggttcagagaatcagtggcagtataacgaatcgtaaagcgtttgaactggccgtgctgtttaaactgtttcccaagtactcgatggactacaacataccgcacatgctcagcgacctggcatcgtatacgagccttaaagagtttttagaatttatgcacgaagtggactcttgccgattgaccacgatcaatagtaagctactgcaaatctttgacatgcaatacatcgatcaggtgattgctcacttgatgggcgacgaagattgcaactatcacgtgaaccctttttgaagctcaccaaagccaaacgcaaaccgacacatgtgcgtgaaatggttagattgtcacacagcatggacaggagcatcgtaaacactgtactcttggtactgttcaagagtatcgaaaagccaggcttgaagaccaactttttcctaaagtgcatcttgttgtaagaatatggttgtaagaatatagttgtcctatacttgtattaataaatctataggtagatggggtatgtaaagtgagagtgtaaactattcattgtttgccacacggtcattaactaattatttctaaatgtctatatgtatacttgtacttgttaatctagttttttgaataaatagtaaagataaatagtaaagatagatagtaacacatctgtgtagaataaatagcaactgtgtgagcaaacatggacctcgaatatctattgaccaaactcaactgcatcaccaaagtggaagaagacggcggcaagtgtaatcatgtcgattttgaaagtcgcatgtttatccacgacacactgcacgtggtgcaactcggtgagatttgccaagaatgcatgagtctagcgatgcacgacaaattggtccgagtcaaactatcccaatatgaagagtatcgagcgtcctccagtgataccgtttggcagtggctacagacgcagcaaygtctggwagaatakagtttagttttatactaatgtaaaaagtgttttatactaatgtaaaaagtgtacatttttccaactacactacaatactgttcttgtatcgagtaaatgcaacattttaaacaacacgtgtacgagtagttattttttagtattagcactagtagtagtagtgaatgcacaatttccaacaacttgatcttactacaaagtctagcatacaatgtttgaaggttactggttaccattgtgcaacctaaatgataacggtacggtgtttaatgaaagcaacaatgaagagtccgataatgaagcgtacaacaataacgttgatcaaggcattgaacgtgatgccagcacaccacccggcagagtgttccgtcgagagcwccatcgatgcattcgaaacggacagaggtgacgacgaatggttctgtatagatttcctcaatgaacgcacaacaaacgatcccctcccaactctgacctgaatgcaatcggatggtttgtggtagactatcaaaacagacgaatccatacaaacgatcccatcttttatccggtactcgagcacgtctacttggaattttacgctctaaaatacattatatttgtggtactaaaaaatataccacgctttgtagttcacattgtagattaccatgccgacattaaacctgaagtgtcgctatccaataatggcattggttactgcaattctaaaacaacaacgacaacagcaacaccaacagcagcagcagcaacaccaacaccaacagcaacagcaacagcaaccagcaaccaagattgctaccatagagactagaggtatctctgacatgtttctagtttggatttggaagggatcgtgtgatgaagcttaaagatttgttgtgagccaatttggaaaccaatttggaaatcaatttaaaatatatattagtatattaagttgtacaattgtatcaagttgtattttttttattaatctacatattctacatctacatcatcatcaacatccacactgtcagtgtcctccaacaaaggccgagtatcaccaccaccaacaccaccaacaccactaccaacaccactaacactacctcctcgtccccgtcctttgagcaaatctcccagattgaatttgacgtacacgaatcgaccaatgatgactagcactaccgcacccactttgaccgtgctccacagattgtcaacgatgccctttagcttggacctggaggctttcggcaatcgttcccagtctgagctcatcggccaccgttatggcggtgggtttgttcagcttgctaaacatggacgccagctctcctcggcgcaatagcgattccacattgtactttatagtttgtactttagtttatactttagtttggattaggacaaggtactggggataagtaaaggatccggattgggtctctaaaaaataagaataccagtgggtttagtttttatatttatttttatttagtattcaatattatttataacaatatttttatttagtatttaatattcaatattatagttgtattattatagagctgcaaaggtgcaagtaaactacaaagatacaattaacctacaaagatacaattaacctacaagttacactagacaaaatacaccaagactcactccaacctagacctctttgctgcactaccttcatcgtcctctgtagcctcagtttcatcaacctcgtccatttctgtaggttcaggattctcttgattttcattacaatctggattctctaaattctcttgattttcatcaatatctgggttttcttgattctctacaaaattacaatcctcctccttacactcttctttaacatcatactcaacctcctctttaacttcatcmttaactttagcctcaacacactcctcataatttaccttcacctctacaccctccacctcttcatcctcatctatcgactttacattacaatccgaaaaggacacgtccgaatcgttggcctccactttggcattcttaaagtcttcaaacacctcaccctcatccattagattgttcatcagctctttcatggccttttcattgtccatattgagttttgtaagcggtccactacatctgccgataaactctttggtctctgtatagtggcaaaagtcattggacatgggacacttggcattgtacacgtccactacaaactcggtactagtgccgccaaacacatcacacaactctttaaacattctccgttcacgattggtggtgattgggaaaatgttgctagtgctactcttgccgcccatgttgctattgctggccggtaaggagccacgctgtggtatcgcacgtttgggcttgatcatattggccagtactcgttgtggaaactctccgctcacagcgtgcttggccacaaacactatgcgcgtaacatgaggacatccgttcaactgttccagctgcgatagtacaatctttggtccggccaccttaaagtaaaactctacgatattcttgtacagaatggcatagcctacgcaatccttgactgcggccaacactgcatccacattggccacactgtccaacgacactcggtaccagttgaacgtctttggtgcgtacagccacttgatgcaaatggacggagtcaccggattccatagcgtggcttgtaaaacagattgtgccgatagccatagttccaggacatgctgcgcatctcggtgatggccatcttcattagtaactccgtgttcgatgcacattttgcagtcttgcaatccaactggtcgcaccttcttttgatcggtacgcttcagcttgaacaaagtagatttgcgcagtactccagatgggcttagagttggtggatacaatctccattttagagagagatggtttttagattagagaataggtatagtcagagagaaccgtctactttgagaacacaataaagactgtaccggtgacaaatggtgttggccaatttatacacacttgtgcgcatttaataaaacattgcataaactctgcactaggccacgtgcacatttgcacaatgcccgataggcactctgacagtgatcgacatgatttacttggattttaaagatttacaaaaactacaattgcccgacaatgcgtggaccgaagagttgatcgatcagcgtccctgtttcgtactgcgcaatccagtctattgtcgagtgttttggatgcacctgtggcggcaacagtctagagacgtttgaacggctcctcaaaaaggacacgtactatgcgtccaatgtactcttgaccggtgtgagcactacactcatcacggtggtctatgtgattgtggwgattkcggtggttgcgatcgcttgctacactagcctatcaaagaattcaccaaagagtcggtggtatgatatgctactcttgttgtaatataaactagcttaaactatgtacttgactttgaatacaacaacaataggctattgtctctattccagcacacacaatagtagatttgggagaaaccgctaatactaatcatggacggtcagacttcgtgcatttccgagtttaacctcgaagagcccagcagtagatttaccctgtttcccatcaggtatcatgacatttgggaaatgtacaaaaaggctcaggcctccttttggacggtcgaagaggtcgatctgtccaaggacctgtacgattgggagactcgtttgactgaaactgagcgagagtttatatcgcacattttggccttctttgccggctccgatggaatcgtcaacgacaatctgttgacgcgattctctctcatgattgagaacgtgcactcggaaatgtactctacattgattgacatgtacattcgcgatccgcaacgtaaacacatgctctttaacgcaatcgacacggtgccgtctatacgtaaaaaggcccaatgggtgattcggtggatcgatgacgacaagtcttcgtacgccgatggccgcaagatttacaacgccaagaatgcctttgatttcatgaccagcatatcactagagggcaagaccaactttttcgagaagaaggtcagcgagtacaaacgctacggtgtcggtgtcaatttggaggataatgtgtttaagattagtgaggatttttagagagatgtgttgacggtggtggtagtgttagcggtgttggtagagtgttggtagarttaattatatgtatagagtctacttgactgtatggatttggttgtatagaattgtataaaattatatagaattgtaatttagtatagtttagagtttagtttcttagacgagttttagcacaagtttcaatacaagttttagtacaagttttagcatagcatactctgtattttttgatacaataaatattcatatgtttaaaaaataaaacttttgttttttaatcaaacatttatttatttatacacatttttttacactcctacatttaaaagtatagcaacttgcaagtaatatcaaaaactcctacagttttcattatagcaacgcacaacattattcaaacaagtacaagtaatatcaaaactcctaaagctaacattatagcaacgcacaacactattcaaactatactacatttaacattatagcaaatcacacatctaacacaagtcaacgttagagtcaaggctcctactaaaggattcgacatcgtttcggatgctttcaatttgactcttaaactctgcactacaatctatcgtcttgttgaacgagtccaaatcgagcactcctcccgacactcgtacaatctctcgagccaatgtytgaatagattggcactctcggcaagtttggcatagtcgacgagtccagtctgaggatccaccttgtacggcatgctttcgaagtgatgtagcggacacgttgcggaatccgtgcgtcaggtggcctccgtcgggcagatcgagtcccatgattctaccgtgcggtttaacgattccagtgtacacggcaaagttggccatcgagcccgagtacggttgtacgcacactccccactcggactcgttcaaattgaacgctctgagacatcgctgctgtgctagcagttcgatgcgatcgataaactcgttaccgccatagtatcgctttccgggcctaccctccgagtacttgctgatgagacacgaactcatacattctcgcaccggtagagtggtaaagttttgagcgcatacagctcgggatcggtttcgtagagattcattactggtattgtttggagcaacgagtctacttgacgagtccccttttgacgagtctaattaacgagtctacttgacgagtctaaaaaactagaacatgaaagacaaactctgagagcaacttgacgagtctacttgaagagtctaaaaaactagaactcgaaagacaaactcggacaataaggattccatttaacgattctaaaaaactagaacatgaaagacaaactcgggcaacaactattccatttgacgagtctaaaaaactaaaactaccaagtcaaaggtgcactctaacgagtccatttaccgagtctaaaaaactagaattgtaaagtcaaactctagcatcaaagagtcctccaagtaacgagtctaaaaaactagaattatcaagtcaaactcggacattaacgattcactctaacgagtctaaaaaactcaaactctaaagacaaacaccatcatcaaagagtcacactaccgagtccaaataacgagtccaaataccgactccaaacaacgagtctaaaaaactagaattaccaagtcaaacgtccaaataccgagtccaaccaacgagtctaaaaaactcaaactccaaagacaaactctatcactaacgattccaaacaacgagtacctccacctctaagagacgattccaaacaacgagtctaaaaaactcaaagtcaaaagccaaactccacctctatcatcaaagagctaaaatgcacaatttcaaacaaaacttgcacaaaagagtcccgagtccatgcataaccttgaggggctcggtgccttttcaaccttttcaaagctgaaacattttgctcgtttctaagagagtcgacaccgatataacaccaatagcgtattagtgttaatattgagcggatttgttcacttttcgcattctgactttagttgtgcgcaagtttgcacgccatagtgtaaatacggtattgtgggacgtcgactttagcagtcttgcaataaatcatggccggtgttcgttcactttttaccgtgccctccaactgcactacggaccttgctcgcagtggtgtgagcaaatccttcaacatcctcatcgagggtaatattgcttgtggcaaatcggccctcttgaatcactttaaaaacttggactcgttcaccgccatagaggagccgttgcatcaatggacaaactttaaagggtataacctgttgcacggcatgggactcgatccagtcaaatggtttgctgcctttcaaacgtatatatgcactacaatgtttaaagctcgcaagagtacgccaaggacactgcccaagagtatgccaggtttgctagggacgctagagatgtgtatgccaaaatttgtagagaggatagggaatctgtgtgatttgcaagtgtactctaaaaattgaaatctatacatttaaccgtgtgctttatcccaacatgtattacaagccctaataaagaatatttacaccaataatcgtctattttttttgattatgtaggcgagcgtcctttgttagtctcttttcctctctctcttgcgtctttttacatttgcatctttagctctatacatttacaaagtatgaagggtgccaacattttaacactggcactcttttggtatggtgcgggtgcatttgataaatacaatacactgcccgatcgtagaaactacgactttagctacctctctgactttagagttaatcctaaacatgcaccaaccatgcgtctagagaatgaacgctatgacaatctatacgatgacaactcgttcaatacaagagttaacgtcaacaatcgcattcatgctacagttagaccggttcgtaaacatttgcctacattacccagacttgttcctacatccaataaattcacgcatacaatagacagaatccattcaatgcggtagatcaagatcagtttcagattcccgatgagtacattgacgaatamcaacaacmrcaacaggctcggcaaatgaatccattcgatagggtatgttgacagaatgctcaaacggtggaagcgagaggctccctccttggagtttatagaggtcgcccccggttccaattctaccattaaactgggcttttatcatggcgatcacggagacggtacacgattcgatggcaacggatggttcttggcacacgccttctatccgggatttgcccaagtatgacagtgtggccaacatgtttggtgaagtgtacgtgttcaagggaccgtttgtttggcgtatgggctcgtttaatcccaagactatatcagtctatccaatcaacaaagtgtaccatttgccagactttgaaaagctagacgccatctacattcgctaaagtggccatgttcatcaatgatctaatgtacgtcttttcgggcaatgatgttgcacaagggtatccaaagaagctttccgacatgggcatcgaaggctcaaagattgacactgcctttagatggcacaacaagacgttcatactgtacaaaatgtcggtgaagaatgccgacccgtacgactctagtgtgttctgggccaactgtcctagagaccatccgcacatttgccccggaacgagcatcgtacaagagactcgccaacggtcaagtggtggtggatgttgtaccagcgggcgagtgaggatgatgagattaaagkagmcyaagattrtaagattrtaagawtrkamkaagattttaatgtagactgaatgtaatgtaaaatactcttaattaaaatgttttacaaaatactctaatgctcagtttgtataccaaagttgaataatgttgtagattataagatgctgttatagacttttgtattgtaccttgtagagtaccttgtaccttgtacttttgtagagtactttgtattgtaccttgtagtgtaaaagtttattaaataaagttttgttttttagtcaattaatgattctagttttttagacactatacctttaaatgcaaagagaatgcatccattcaactctacacatttctacacacacacatgtctttaataaaatgtacacacatgcatacagagagatggctttaagcacctgcctctagtatcctccaactactctaaacgcctgctactagtctttagcaacaaatgtcaatttccatacaatgcatgtgcaaaacacaaaggctcaaacaaaggcccaatgtttaggaatgcacattgtcaaagacaaagacactacacttggactgtttgaaatgcacggttgactgaatggtgctcgggttgactgaatggtgctcgtgttgactgaatggtactcgtgtgtcgagacttgatacctctgaggaccatcttacaaggggttgctagttttagttttttaaacaacatgtaaatgatttgatgaaaaaaattaaatcatttgcaactctgtgttttgattctctttagcataccagtacttgtgaataacttgtgaattggacaactcagtgttttggtacttgtaactttagcatgccaagtagacttgaaccatctctctacttaaaatattacaagtgaacttgaaccatctctcttaaaatattacaagtggacttgaaccatctctctacctaaccaaacctacttgaatagtacaagtctataaaaatcaaacaatttaaataccaaaaaangaarcctttatttattcaacaatgatacatggtcaacttaatcctacaacttgatacaacttatacaactttatcctacaatttagacactggtttacaatactcttagtactcggtagagctcatgaggtacgttagaatgttgcaaatcttttggttgacaaacaagtggttggatgatgaaaactggccatctgtacgctcggcgacagcctcctttgttgggtacaatgtttagaatgtgagccggtggaatggcaacatctatgggatcgccaatgcacatttgaacaccacgagtgccgcgttcagttacaagggtcggaatctctatacgctcacaaatcagttgtgcgatgcgatcaccctttgacactacaaagtcgtcatcggaatggttaaagagaaccactccaatgtttccagtatagtcgcggtccacgacaccggctccgacgtcgattccgtacttggctgccagtttggacgcggagcaatcctaccgtagcaaccttccgggatcagtacgccgaggtcggtgttgacgagcaccctcgaccgtttaggaatkacgacctcgtgagcgctgcacagatcgaatccggcagactcttcggtagagtggatcggcatcttggcgttcttgctcagtttacggtacttgaggactggggcagacattttaatgatttggattcagagcagacaagatgaagctaagagagctggatcacttgtgcaattgttctactaatgttgccccatttataccaccaataccgtattatcaataaatgtgtcatatagttgcgtaattaattacattttataattaaatgacaatttctggtgtgtgctcttgatcagtcattctcagagctccacaacattataccatttcaatttgagatgcactcaactgaaccaccaaatcccctagactcattgatttcaatattgattttcaatatagagccaatcaaagagtttacgagtccatttcattaacctgacccgattccatcaaagtgtagccataaacgattcactctagagtaaataggatttcaaacaaatggagacattaaccacgactctatgctttaaactcggaagagtaccagtactatcaaggggttaaaaattaaaaaacaagaagaatcttttgatgaaaaaaatagaatcattacactctttattcaacatttatatttatacatatataactctactctataaactctactctataaactactctataaactctgatgaatacaaaacaaacatatagaaatctaaataaccctaaatgtaaaatctaaacacaaggctaaacacatggctaattaccaacatcaacagcaaacatcctacaacaatatagacatgctatcatccgagtccaactgaagactactaccactgctgctactgaccggttgtttgacgagtgcacgctccctggccctgactcgttccaacagactgatggacggatcagattcagaatcggaacggtcaaatgaaaactcttccgagtacgattctatggtgctagatttgatatgtgacagattcagattccgagtctagggttgacttggaggaggcttctttagagtttgatttagaggcttcgttagagccattggacggctctttgctttcgtcctttgaagtggctttatcctcagagttggactcagagttgtcctcagatttatcctcagaagattctttaatttccgagtgattcgactcttttgatggaatgtgttttgactcgtctttgttggaatctttgtgttctttagactcggtaactcgttacctgttgatgtattcgaatctactctatcacatccaatagaatctactctagaatcaactttaaaacggtgttagcaacggttgagtgtaatcggtgcccatcattataacgattgccgaaaacacattcctaggcataccgcacacgttaaacttttgcagattcacaaatcgttcaccgccattgagcagcaggtacaggggagcctcatcgtcgtaccgaccgtatgcaatgtgctttcgcccacctccaattgtaccactcggaaccacgactcttcctcgagcatggccttgtagtactgaagcgctgcctgtgcgttaaactttagatttacggcacgcttctttgaagtgtcatgtttgcgcgtaggaggcaagccatcgaagtagattacaatttccgaaataaattgccatccacatgtaccgtatactctaggctgggatcgggtgcgtcgtacgagtcgacaatgtactgcttgaaaacgttgttaaactttaggatacccatgatggttggtgggctctgtcagcctgtatactagataccaaaaagtaattggatttctacaactatacactagttttaaacactttatccactacacccacatacataatgttgcccatttcatccatggaatacagaccgaatggatgaatctcaatcttgtagaatttcatacgatgaaaggttgcaatgtaggaatcgatgcatcgttccgtgtccaccagatgcacagtctcgaccagattggacacmctgggtrmactgggtgcactggggtgcggtataccactgcgtctgmgacacttgtccgatagcgtagaaaagaacgtggacaggtagcgagtggcatcgggtctagtctgagacataccctccaggacagtgccagtcaggttgacgctcatcagactgttgtagggatcgtttttggaattgctaattgccggcaccttggacatgagcaccagattaaagccgggattcgagacggtcaccgattcggcccaaactatggagcacggaaacgcattcggtggacaccgagtgtacgtgcccagtgatccagagacgcgtacgtggatcgaatcgtgtacgggtactctaccatgagtatgcacggtttgtgcagaggttgtagaggcccgcatcttgtacgtgttgattgtgtgtaaattggacagtaccagcattggtagcttccagagtactagaatcggtacttttaaaactaccattgcttttagcactcttgacaatgttggcacttttaacattgtcatcaatagtactctttgagtttccgagcatggcctttttagtgtacagtttgatggcctctgcaacggtactgggctctggcatttcagagttggtaatgggtttggtattgcgatagagttccgagatgaaactaccgttcattttgatgccaaactagtacccaagcctactactactactaatactactactactagtaatcctactattagtaatcctactattagtaaattaaaatacaactcttgaaaactcctacactaaaaagatataacctcctccctcccactcaacgcctcttgcaaccgcagcccaactcttgctcgttttcgtttaccggtacgctgcctcttgctcctgtgtccgattccgaagagtccgagtctacactgtactcgctgtcggtatcggtactttcgattctcttcttaccgtcgctctcaatgtttttktaatagtctagaatgattgacaaatcgtccctatgcaagatagagacacgttgaaaaactgaaattaccgtacaggtagtgtaaacatagtcacaataggctattggtgttattaacttgtgcattgttatagtatgacgatggtttcggtcggttctaatacgggagtctttgtagttttgttgactgttttaaaggccatttgtgattcgtttattgtcatattcttgtacttttcaaatactagttctagtaattgtcccactgtaaactgtgactcgaccactggtactctggcagctagataggtaggcagtgctcttgtttttgggaatcatgtttgcaaacattcaactgaaccagcaacagaattgcgtagtgattgacaatgtaccgtacgaggtcaatggcgacttggagtttctttatcgtacgcgcagatacaatcgctaatgaagacggtcgccggactcatgaacaaactgaccaactctcagctcgtaacctacctgatctcatctacgaccgatgctccaaggtgctgttcattgacggtgccaatcaggtggccagcggcatgtacaacgatctcaagattaaatatcccgaactgaagagtatcaattctgaaaacgatttggccaaaattaaacacttggaggtggcattcaacgaggagaacgccaagtacaatgtcaacctgtttccgtacatgctcttttacaacatgtccgatcatccatgagatgcgtaaaaatgtagcaaacgatgttgagcaatttgaaaagtttcaccagttcgtcgtcgagtgttataataatctaattgagcccctaaacggcaagcactatgcaacctacacctttgactctatgcaaaagattttcacacagcaagtcaatccgggtagtctaatgtagtttgtaagacattcatgtactcttgaataatgtaaattttaggtttttctttttttaaccacacctctaatacgctattggagttggctctttaacattcaatgatttcatgttcctacagtggtattgttgtgcaatagatgatgcgcactcacaaaactccatcgggcgtctttaaggttgaaattatgaaagtggactcgttggacaccgacactgaaactgagagcacaatgagtaccaccagtacagaaactctgtcggactctgaatcggatccgtcctacgagtccgatgatggtactctgaccgatggctcggatgcgtcctctgtgattgatgttaaacccaaagaggatccgagtccaccgaggcgatggtggagacggggtgtcacccagatcgaaatggagcccgtccgcaataattacaacgattccgatcgacgagtccgccagtagtctgtgctcaccgaaatcacccgagtgcatggctctgcgcaaagtgtacgcagtatcaaaaatggtgtttgaaaaaactagcatcgaaaagtgcgttattgtactagattagacggtagtataaatacaataacttatggcggttaatgttatttgcagtttaacagttgagcaggtcactttgctgtgatataagcatggcttcgtccgcgtcctctcacatgtcctttaatatcatcgagtatgggactcctcaaatcaagatggatttgcctcgtttgaagaatccccgtacctcggccgagaacccctacggagctgatggctcgaaaggttgccgaggtgggtgtcgataaggatgtcgaactcgccgacaccgacaacaccgatatcgagaggcagcgcaatcgtgccaaacgagcctctttggaatcggactcgtaaacgtggcatcctggacgccaccgactccgagtccgaggccaagcgtaggcgtcaggttgacgatgagatggaaaactttaagttcttgaacgagcacgttttcaacaagcttgacaacatcaccaagaaggctcaggcggagagtagtcaggaggagccctctgttccggttaggcgcagtcgtccgcagactccgcaccacaagcgaaaaccaggtgcagagtaggcgtgacgattctcaggatgccagcgatgaagacgacgagtgcaacaatcgtgagttgtctagaaatagttttaaccgtagtgtgaatagtggtagaggtagtggaggaaaaggtagtatagctagcagggccaatagtagatctagtagcagagctagtagccgaggtggtaagggccaatagtagatctagtagtagggctagtagccgaggtggtaatagatcggacgatgaggctgaggaggaggacaatgaggttaacaatgagggtaatggggagaatgctaatactgaggttaatgctaacgagtccaatgtttcggccaatgttgatggttctaatgtagatggttctaatgtaaatgatgtcgattacgagtccaaggtgatttcaacaaggagaatcttgctccttccggtaaagagtccaacattgaaacggtagcattgggctcggccaagtccaatattgatgtgtacaattttgatgaggatgacaatgccagtgtcaagagtggtactagtgcatctcagagtaggaaatcaaagaccaagtccactattgctgtaggcaagaatctcgatgatcggcttaaatcgttgcagttgaatttagagttgaccgatgccaataaggggaattctaccaaagggggctctttgttgaatgcaaatggcagtgctaaaaactcggttaagaatggtagtgctaaggggggctctgtaaaaggaggctcggtaaactctaaagtcaacaactccacctctaaaagtgcatctaaatctaaagccaacaactcgtcatctgaaaagaccattaaaccaaaggttgtaaaatctacacctactcctgtacctactaaaactcttgcatcacactcccaatccaaccatcaaacatctaacaaacaaacctcttctcaatccaacaatcaaaactcccaatcttcacaatccaaccaatactcactccaatagtcaaaccaatgctcactctaatattcaatctaatgatcaaattgatactcaatctaatgatcaaattaatactcaatctaacacgcaatccaacactcaacctaatacgcaatcctcaaccgctcctaacaaacgtcccactctaatcaatcacgccaataccaaagyctcygatcgtatgcacgaactcaaactcaaaatgaatccacccgtgccgctttgacttgcaagcagtgcaacaaaacctacaagactgcacgcaatctgtcaaagcacacgtgcaagcctaaaaagagaaaggaagctgccgagtacaccgctgggtgtgccggtaccgttgactagtaacagtgccgacaagcaggccttgtacgatgagtttaaagtggtagagccgggttttaagcacatgcacaagttgaacgccatcgatacgcacaagcatccgatagagttgcatgaaacgtatgcttgcaaggttagcgaacttgcctatgcacagtatcacaatgagacgaattgcaccgctgccgagtttaagcgtgaaacggcaaacgtgcgtcagagtctatccaaacagattgccagtattcaaaatcaactaaaggacaagtctatggacagctaaagttgcgcataaagtttctgcgcgcatacaaacagatgaagctggccgatctcgtcaattggcaagatgcaagttgacgatggcgatttgacgtgcatagctagatctttggagaattacattaccctcattatgaatgtaatcatttgtcgcaatgtgttggatttgaacaatattacatcggtggaccaagtgatggatgtcttgatggacgagtttaatggggagttgaaaaacttgtgggtaaagtttctattctactttaagcccagcagtgactatttcaaagtcatcaaagagttttacatcaagtacataatggcatcgtatatggctctgtgtaagatggaggaaaagagggcctctggtaagcccagcaactttagacagtgcatggccattgtgattaacaattgtacatggttccccttcaaggactatgccaatcataccgatgtgaatctggaccgacaggccgatgacttgtttgagcaagcagtgccggtacgaaacgcaaagcaaacagagtcaccaaagaggtgcccactaagaggcaacgttgcgatagcagcgacaacgtaagcctctagcaaacaagcccactacaccggctgtcaccaaaccaaagagagacgatatgatcgagggtggatactttccgatgagtcgagtcgttaaaattagaaggctcgaacagagacgtatggaggctaatgcggcaaatagaggtaaccttaactctaamgstaactctaactctaactctaaccataactctaactctaaccctactcccactaacaataccgattccaatactaacaatactaacagtgctaacaatactacccctaacaataactaacaatactaacaatactaacaccactaaccctaccaacaacactcccaacacttctaacagtgctcccaaaaagcgtacaagtaatggttcgcgcaaatctagtgcatcgtcaaagattgaccctagcaggataaagtctcgagagttgattgagaatgatgattttagcagtgatgagaattagagttggtctttgatttggagttttgattcatacttggatgtaatttaaatcatgtaattgatcttgtatttagtcttgtattcaatcttgtatttagtcttgtatttagccatgtaattgatcttgtatttagtcttgtattcaatcatgtatccctagagtataagttggtgtaatacaagtttccataaactataaccttcaatgtatccctagagtataagcttcaatttatccttagaatataagttgtattattagatataaaatgattaaaaacaaataaaggtatattaaaaaatactctatatttttaaaatgtgtacagtgtaatattatagcatctagtatacaagtgtagtataccaagtgtagcacaccaagtgtggtataccaagtctgtgatatataccaatgaatattaatcaaacywttgtatatactagcattaagtattctttttttagacactctacttggacatgtatacttaacactaacctaaattactacttgcattttaccacttgtatgtatatcttataacttacaaaattataatctacaaacatacaatctaccaactagtacaaattatgactttaaatctaagactgagttgaaactctaaataaatgatgaaacctctaaagatggactctttgatttaacccttatccttgctgtatccactgaaccctaaagccaaatataacccctgaatcttataaacacacaacttggcgcctacctttaaatgcatagttttgagcacacgtgtacaatgtatgaaagaaaccaaaaggcacaaacctttgttgtctacacagagtacaacagtttaaacttggcacagattgtaaaccgtttacaggccaacgaactcgtgtatgtgtaatggaggttgtgatcttgaacttgaaccgagttgtaaatggagcatagagtttgcgcagtagagttttcatagagtaggtttgtgccttgtgtagatggtgttagtagtatactttggtattgtacttgatttgatattttttaaataataaaaaacaatactttataaatataataaacaacatctacatacaatgtaataccttttaataacatgcaatacatttggtacaacttggtctatgagtattctttgaaactacatttacatttasrtacatttacatttacatcaacaactacatctaaaactccttttcaaaatccaaagccacactatccaacacttcaacatctgaatctgtgaggtctgaatcggttcctcctacacaaaccctatcaacgcctactggtatgtttgatgcaacgcactcggtagacacttgttgcaactcctcaagcttgcaacgtttactctctggctgagaatcttaatcttcaggttgcgctgtagatgccgagtgttggtctggttcgggttctacggttgacgccaactctagctccaattccaaatccattttattgacaacacctttaccgctaaccttcctcttggagccagcctttaaaggctccttctgagctgtactctttacgtattgtaaaatgcactcgttgccttcgtcgtcgtagcacaccacctcgtcgggatcacaaccgatcctgtggctcctctttgaacgtgcacggacactgtatcgtgtcgtgtagctctcggcggctcttgctggtgaggccattaaagttgacactgtccttgatgtgtttgtagcaatctagcaacggtgaagtgtttgtctgcaaagagtctacatactccttgtacgtggttctgagcactcgtacgcatcgaccctttgatacgcgaaaagcttcaggcgtcaccactggaaacgttaccgtcttgtacagataggccagcacagagtttatctcggatacgagtcaggcccacgtagactgcattcatggtggtatcgtccaagtccagttccatgtcacacttgtccagagttaatccctgagcgctatagtaggtgttggtaaagaatcgcaacgggtactggtagcgagcaccctgcgacgttagccacactcgtaaatcatcaatggtattgtattaccacctcaatgagtgtaggtgacactttacgcacaaactgtaccacatcctcacacttggaagtctcgctgtacttgatttatgacgctctccttgaagcatctatgtatccgatccttcatcttgcgatgagtggccgtcagaaacatggccgtctgacactcgttaatgtgaaagtgtctgtacagcaaagagtagagtgtatacttttcatggaaatccatgcgtatattgtcgtgcttctcgtccaagtgcagctctatggtttgtatcgttgcacggcaccatcttgaatgtcttgagcaatttgagtagatcgtaaaatatggaacagatcgtctttgactggggtgcgttaaagatgcacttggcctggttgtacgagagtcccagagtgtgcataataaaattgcacgtggtgcgagcattaatgtttgtgtgcagagtggccgcatcgtctttgagcgcattgctataaactacaaacatgatgggtgtgagcaacgaacacgccatgacacccataattgtggatttacccgtgcccgattttagtacaccgaaaaaggagtcttctatcgagtgaatcttgggcggtgtatacttgccgtctagactctctggtacgcaggatgtttgtktmtaatctgaaaggccaccttttgactagagtttagacagtggtacgcggcattggtctttcggaggcatgcaatcgacgaatcctagaacgctgtctggcaaatcgttgactccgtttgtaatcatgcgacatccctttacgttacgctgaccgttgacgatgcacagtttggccacttgtacaaaattggccctattgatgcgcgtgtcgggagtgttgattagagcctttaattgatctacatcgtcttgtgtaatgtcacgtttacgcaccgagtgcagtaaacgtacaatttcgataacgcgctgagaccggcttagtgacgcattcatggctgtataccactagtgtatataaatatcgaagtatttaaaatttcatttagtacaatacggtattgcaactataacggtattgtctaacgtagaattgtagcatcaagtaaactagtactaccaactttgtattcatcatgatgaagacaaacattgaatctgcactcaaggctcctcagaagaggccagccagtgccatgatgggcaacaacgtgatgcccagtgcgagatcggccaaggttgatgagagcctctgggactcgtcgaatgcggtccctgcggcctctgccgaaactgtagattttgccaaaaacattaaactcatcgagccaccgccgcacgtgaagcgcatacccaagtttgtgcaattggaagatttcaaaaaggccctggtagagtttattaagttggatgtggagcatttgtttaccgatgagggcaaaaaggccaccaaggtactgtaccatgccgtagagtatgtctacaagaatctgtatgaagacttgattacgaatacgggtgatttaaagtttatcgaatggtgtctgcactttttatcaatctacacggcagacgccattctcaagctaaaagagtttataacgattgcgaccagcagctgtggggactcggtacgcgtagacattaagcgtccctgcctgggtaggtttggtaaaaagtccaaagtcagcaaggatcagatggccgagatgaatcgcaaagaacgcgtaggcttcatggtaaatgatggagttcgcaagtctggaaatgtggccattctgattcatgtttgactttacctttgacgaggacgatgatgatgaataggatggagtgtttttgtattcagagttgcatttgagtgtttttgtatggtattgtattagagtagttgcatttgtatgtaataagatttgtagagttgttgataaaataagagtttaaaaaaatatgtattctgtagtatgtattctataacattagtattacttgaataaatgtagttttttgatacaatagtatgtctttatataatttttaaataaaattttattaaatccaattattaaatataattctaaatgtattgtacatgtatggttatcaataaaacacaaaactctaacaatatttttttaactctacaaaagtgaacctctataacaaacatccatctctaccttaaatgatccaacccactcatcctatccactcatcctatccactctcctctaccttaaacaatcaaacccacctaaactagcctacaataaatgtgccaccaactgatccctagtcttgatgtagtagtctgcatagattcggtactcgagctcagactctattgaactcttgtcgacattggtgaatctgtaaaagtctacatatagcgcagcttgatcattattaaccttggtggtggtagtagtagtgttagcatcagcatcaacctccaagagtgcaccggcatcctcaatgtgcggtattgcaaatggtagtctaccggccagttttgtcttgagcgattcatcgaatcgtagcatgtcttcgtcaaagtttaacaagcacactagacgtttgcccagaggcgatgtgtgcaccgaggtcacatagagtgcctttagcacagtcataaactcgtcgtctctctcagagggcggtgtcgaatggtacagtttgaccagttccaattccttgagcctaaagaagacctcgcctgttccacatccaccggcagattgttgattcgattacagtcaaagagtacaaacttgacgagttcattggcagcgtaaacttcatcaaattctgtacgtttgtactttttgcacaaaatgttaaacaggtacgatagatcacaactcttgcccattatagtttcccagagtcctttgagtacgagtgcagcatcgatatcgcccttcgttgagcaagtgtatagtgtttttgttgactctaaaattcaaactcttgttgtcctcttgggaattgtacacttgcacactgtattgacgttgcgctcggtacgatgccctctgggcagattggtgccgatcgcacgcatcagtccgtaacagtagccgtgatcgagctatcacggcactcgtatactttgccagattggatacttttagtgggtactctagagtggaggttgtatcgtgcaacgactcttttaagcgttgcaggatacctactaggctggctctgctctgggccagtactcgcaccagtagccgattgagtgccagcgtcggtatggcatttgttgttgtagttccatttgatttgtataggcaactcttttatagagtaacgagtctacaaggttacaagcttagtgctagtttaatatcaaactaaatacaaagccgtgtcggtgctttgcattgctaaaaaaataaaacaaggttcggtgaggttgtctcaaaaataagtaaacagattctacttttgtataggtatttattaaaaacaatctgtatataaaagagtctactgtcaaaaatacaaaatgtttacagtgtaatacagtacaatataatctaaaatgtaagaaatctaaatttataaatctaaagacaaatctaaatctaaatctaaaatgtaaatctaaagacaaatctaaaatccataaatcaatccattacatgtgcactccatacacaccatcctcctccacctctacgcactctttccagtcttgcaaaacagcttccaatttgtctgctgcgtaaagtacataaacagagtcagtgccagcaggcagattatgacaatcttgtaaaacagtgtaagctcggccaatatcaatataatgtggtcacttccttggcgggagtttcgctgggcacctttgacgagctaggagtggctgacatgatgagttttctcttcttgtgtaaaactagacccttttcaactaggatgctatccatgaataaatgtatcaaaagtcgtacaatacctgtgcctaaacaataacctagtacaaagactaatgcacacgaccaacgcgaatgcttgataaaacctgaatgaatttgttcagtttatatatgctccatttaaacacctactagtgattattactgcaatacttgttatgcgtttaattcctattgtctttaacggtatgcgtcaacgatactttacagaaacaacatgcagatgcaactatgaacgtgtggatatcgtttagtaccatttttgcgcctcaactctttatcaaaaacatgccagagggtttcactctgacgaatcctatgcaattgtactatggccacaagattcaccggtaaagtttgacgaaaagactatgactcgcaatcgcaacggtttgtttataaacctgctcaagtatgcgagatcgttgtatgcaaaattaaacattaacgtggtgatttactacgagtctgatatgccgcctctgtttatgggtaatgataaatcaatcgaagcggtaatctctatgattccagcataccgtctgcgagcagtgacacatgcaacttggaaggataaggattgattggagggggcatttatacaagtattgtagagtgtactcgtatagctaatagatttagtttaacatttgtatcaattatggattacaagatttttataaagtgttttgatgaataaaaatccttgttttttagtaagtcaactctttgagttcaagtcttattttttacacaaaccaaaacttgaacgaattcaatattagcgaaatcgaggccaagcacacggaatctaataaagattctaatttacaacccagcaacactgtaacaaggtttaaaggcccctttcaaaacattaaatacaagaacccctctacagatcccgtaatcatagatccgggtcagacgaatctttacgagtgcactccgagtaaacctaaagaatgcaaaatgtccgatgccacttcgtgcatgggctgtaagaatctgactgcacgatgcgtccacctaaaggaggacaccgactacacagacaccgaaaccggtcaagagtttaaactggccaagagcaagaccctcgacgacggttattgtctgagtgtgaaaaaggttgtagacttgtgcaatcccaatcacggcatacaacgagcccgaggatgaaaatcaaatattctacaatctattgtgtgtctgtaccgagccgggctacgtgggtaatctgggtctgttgggttcgtgcgaggatccctttgtgtgcaacggtaaggttgtagacattaatgtacccctcaccgaaatggtttgcgagtgcggtgacaatttcgagtttatgcgcatcaacggactgccaacgtgtcagattaaatcgatagacaacatgacaccgaccaccgagcccatagtgcccggttctgtatccaaacagaggtaccacaaaacgatcgcagctactggcaggcgatgagggacccgatgcgattttggycatttccaactacaccgtagacgtgtacggctacctagaggacaccacagtttttcgatgcgctcaagattgacaaggacgagtacacgctactgattcggccctatcatcaggtaaagtttccgggcaactttaagattaccgatcgcctgtacaaggtgcccaatctgaaactgtacgagtacacttggacgtacgatttcaaattgcagaatccggcccccgagtctagtggctttgtccagtacctggatccgtacacgttcaatctaatgtacgatatgctatccatgtactatctgtggggccggacgtcgtactatacagtcatgaatctgaaaccgtttgtcgtgctcaaaaaggtcaatggtctcagtgtgtactcgaacaataagaatctggcaaagattaacgatgaaaccatgaagctccgattcctattctttagatttgacttttcaatggatcgatcgctagtcatgttgactgccgagaatcgatacgattgggacaagtatcacgcattgcgtataaaggagggtgaatgcggtggacgaatcgtacgcggtgaatgcatagatccatttggtgtgtagactgaaaattacttgaatgtttaaactctttgtttacttgaaatgtcaatgttggtatttgtactagtagtagtaatattgcaccattaattctaataaataataatagtaatagcttattagtgttgtaaaattgtagaatatagtagggtctttgcaaactttacgtgtctataggtaaattcagacattttattgctcaactttaacttgtaacggcatcatgtacaagcacattaaaccgatgcaaagcaagctgcatcaatccaacaaattgaatcagcattttataccgacacctagacctctgaccgactacaagtgtatatgcacagaggcgctggaaacgtttgccgtagcgcctgcgtccaaaaacattgcactagtacgtgtgtagtcgcagaacctttctgtccagagaggagctgcgcgagttggatcggtgcattcaggcggttcagcacaactttaatcgtagcgtgtgtgtttcccatttggattttgaagcgtccgatgtgatgctttgcaatacgagcaatagccgagtccgactgcccattgtgcgtactccgaacaatgcacagtctgtgtgtcaggctgcggccacaatgtgcggtcaagagattggtacaattgatgaagagtgccgaaggcgatattgccaagttgacggctttcggttagggtgtgtgtttgagagatttaggtttgagttgaaagttgtatcctagagtgacgagtagagcaatgtgtgcgtggaggacactggttgattatttgtgtaggagtttcttaaatgtaattcccaattaatttatgtactttcaatttgtgtagattttaaattgatttatataacatacctcaataaatacaaagattcttgatttgtgttttttagcatctaaacaaaaaaagaacatttattacacctctctgagacttgcaagtctacagtagcatttattcgtgaccgtaaactctactttacaatcatataattaccatagctcgggtaattttacttggaacggctctttatgcaaacaacaaatattatgccaatttaaagcaacccatgaatggggcaccataattgtgtctataaaatgcacacaagacttgagggtaataaaccgaatgctgaatgcagattgtgtgtgcatgtttggggtttaaaatgaaatgtgaataatgctcggattantagtagtacagtgaaaagatgcatttacttttannnntaatacaaactatgtagtagtgaamattaatgcttatatctaaagtgcagaataaacacaactctaaagtgcagaacaaaccttaactctaaccttattctaaaatacaaatcaaatatgaacttgacatacatctcaaacctcaactctaaaacacaactcaaaacaaaacttaataaaacaaccaaaaccatcaaaacaatccatctacatgtgaaaagtcagcatccaaatctttgtacgatcccttactaatcccagattcctctctgtcgatatcgtgttcaataatagaatcatgcacaatccttgaccttttcggatcacaatcaaagctcagtttgcgtttgcactttaaatttccaacagagtgccgtttgcgtttacgtggtgcatccaacaaatttaaaatctcttcatcatcacacaactcaccctcttccagttccgagtctacataggaacgtttgaccgtcttggatttggacttggacctcttcatcagctggcacatcaacaggccacactgcctgaatctctggcagtctacgattcaactttggtcgtgtgattggtttcagtttgttaaaatggttgttgtggttgtggttgtggttgtggttgtggttgttgttactattgctactcttgttgtactttttataattcttaactttaaaagttgtaggatacgtctgatttagagtgcaaggtttggtgtacaaattgttattgttgttgtggttgcttttgttgttgttactattgtacgagtgtttaaaactcttgtagtgagacctattcttgttcttgtagccttgatgcttattcttgcaattggatctatacgtatccttgtactgatcataatattgcgtgttgttgtattgattagttgcatgctcaacctttgaattgacccatttagaattaccataagccttattatcataacaatgttcagcattagaataaccagtagtggatcgtctgcgtttacgatgcaactcgtcattgaactcggcgtgatccttttagtccgagtgtttagagttcgagtgtttgtaatcatgatatttatactccgagtgtttggattcagaatgtttagaattagaggttttggaatatttagaatcagaatgtttatatacaggtttacaatccgagtactcggaatgtttagttaaacttgaactctttacactaaactctttgcactagaactctttacacactttgaatgattctcgatactagcatcactctttggactctctacaacattttcataaaatgctacactttgactcgctacctttagaatcactacccttggaatccttacaatcaacattctcaacattggcatcctcattataatcaacctcagacaaattgaccaaatcatcatcctcagctagctcttgttccaatgcacattttaacatgtgcagtggagtgtctgaatctaggctatagtctaggctgattgattcagcatcagattgtatcggctctattggcaacggtgtagaagtgttgcatggtggctctttcaaaacattttcactatcctcttcaatgggtttaatgatcgactgtggtctatcatacttgtacggtctagcatatcggttattgttgttgttgttgtaaaacttggaattgtaattatgaccattagtattgttattgttgttgttgtatctacgattgttgttatagggcgccttgtaaggtgtaaaagcagatctgtttggtgctttgctaatggtatttttgtaggagttgtaattgttttgattttgattaaacgaatttggatggttgaatgaattgttaaagttggggttgttgtagttattgttgtagttgttgttattatagctactgttattatagctactattgttatagttgttgttgtagttattattataattgaaattgttgttgtcattaaaaggtacattatttggatagttggtgttgctgttgttgctgttgttgaatggacacggatagggagtgttattattgttataataattgtttgaattggaataaaggtttggataattgttacagttttggtagtttggaaaagagttgttattgttgctattgtaattgattgaactaaagctgcaattgtaatcgttgcaagagcaaagagtcggttgcatgtagttgccattattaggatatccagaattgggaaaagagttgctaaaagagttgttaaaagaattgaaagaatttggattattaaatgaatttggattgttaaaattggtaaaagagtttgaatcaaaagagccaccattgcaattgaaactagaattgttgggatggttaccatacctgtttccacttttaaagttgttaccattgttgtaattgtagttgttgtaattgtacgagctgccacctccattgccattgccattatagccacgataacacaatcctaaacctgaaccaactcggccaacaatcacactagtgctcgttccaagtggcgagccattcagtcttgcgagccattgccgactcgtcttcggcatcgacaatccaagagactccgacctcgtcgattatgcgctctccctgataggtgggatasgctacaatggaacgwgtcacattctccatcatcatttgcttgagttgccgcacgtcgtcagaagaggaggaggaggatgaggaaattgtagaggatgcagatatagaggccatggttgattcaaaagccaaaaagtaaattggatcagacttgttgtcttggggacttgcaccacaccactggtactgatagtggtcgtgcaccgtacttttaaagcttatctctactacattttatgttgaaatattaacaatacgctatgggcaatataaatagcacaagtttataagttgaacatcaaacgttgtacgaacgttctacagtatacatctatacatatactaatatcaacttgaaaaatgtaccaatacacggacgttgacgatttggatctcgtttcgagcgaactccaacccgtacataatgttgtcgaatttagagactgcgacctagagtatggtcccgagtgtctgcctccggctctgcgcgaagtattctaccatgtcaatttcaagtatcgctcgtttaacgtactgcacccaaactcggacttgtacgcgctaatgtgcttctttgagacggtggttgtcgatttggaaaagtgcatcgctgcccttcaaacgcttctagtcaactctaaactcaactatacaatagacacaatgttcggaccggtgccgtggaacgatacgattttaccgattctatcgatgccgctaccggcagagtctctggttcgttaatattacaagctgcgctcaaaagagcctgggaccagattttgacggtaccgtgcaggtgctcaaactgtctcagtacggtggctttattaacgatctcgtcggcatgcaatgcctgccagtgttgatgcacgcctgcgaagagtactctactagcgtcacggataggtgcgtctttaacaatataatctggaaactcatcatgtcactgtttgacgcgtcctctgatcaagaactgatggagggcgcctacaaggcattgcaatctgaatctgctagagtttatgaaaaagtttcccatctttgtactggtcgactcgtcgatactcttgaatagaaaacgcatgtttaaccgaggcgttgacactctggagaagagcgaaaaggttaccggtgacttgtttcgttgcaagattgtaccgtatgtcaaggctagaatgtgatttatggcacactggccacgctgtgtgactggccagtgattgatgtcggctacaagtttccattgaccgcagattggatgtctatactgacgaatacgttttgcaataaactcgttgaaaactacaaagtatcaaaagctctcgctaccagcaccgcagactcgcagagcagctgttcctcgagctcgaccgattccgaaatgaattttaccgaaacaaccaccgacactacacttcaatctcagaggacgagtccagcgtggccaccgttgtacccaaagagtccaagacggatgtgcaaaacaagatgcgcaatttgattgtttgcatgcactctatgtatttagtgactattctaaacctcttgtaaccttttgaaatcaataaagtctagttttttaagcactctattgttgttgtaagttgaatgatgaatggaaataaatggtaaaaaagtacacaagactttgattgctttaaaagtatcaatgtaccagtaccaacactaataccgtattggtactatatttggttgaaagtctaagaggcgccatcaaaatgaatattgggctccatgtccatgcacgccattataacgttgctctttataatactgctcctgtggacgacatggactctggtgcagcatgagcgattggttttcgtcaaatgtaatgtctgtaatcttgactaaactgatgccaccggccaagaccaactcggtgaagccctttaaactatccacacccaagactcgaccagagagcccagacttgagtatgggaccaccgcccaaagattttgcattcaacacggccgtagtacagagagtgaggatatgttgtttagaggttttagaggtttactttagagagttattttagaggtttcttttagagggttgtgttagatgtagtttattttaaaggttaaaagtttgtttaaataaataaagttgatttatagagacgtttgatagtattactttagatgacaataaaatgtaactagagtttaggcataggctcaaattcaagttgttgaattcttgttttttaagattaaacatttactcttggatgtagaaagacttgtaaatagtacctttatttggacatggaaaatccatctaaatttgaatgtatgcgtgtttagtttaaaacatagaaagacctagatattgttgaactctagggttaccgataacaacgtgttgaattggtataaacattattacgcatagcctcttttctctccatgttcaactattcggcaccttcaagtgcaccggacactgaactgccggacactatcgatcggtgggtcattgcgttgcacgcatcatacagtacgtggacgatcacattggcgatcacgtttccaaggagcgctttgaggatcacttgaccgagattaagagcatcatcgcccaagagtctatgctactgggctcgttggccgatgcctttttgggctccattctaaagagtaagattatcgatgaagacgaagaggatgaggacgatgattccaatgatgttgatccagatgcttatagagggcacaattcagacgatgacgatgacgataatgactctgatggaggtgccaacggttctagaaaaagagtcacaggataaagaattcaagggtaccgagtcatcaaacaagcgtcgattcacctctgacgagtatgtgtacaacattaagcgtttccgcagcagtgaggaagagtttgaatctgaccaaatgccgaatgcgttggatttgaaggactactatggtgacagtaccagagcacaagccaaaggaggtttatatttcaactawtcttccaaagggttaccgtttggttgatrrcaacaagttgattagagtcgactactataactttgtgaatgagcctacggatgagcctgatgaggagtctgaggaggaggatgagaatgaggatgaggataaagtgtttattagaacgtatgcttcaaatgtttaattgtagagtagggttgtataaggtagagtaaggtgtgttgtagttgtaagatttgtagtttgtatttgaagggatctttaaagtttgtgggcatctaaagtgtaattgtaacaagtgtaattgtacttgtaattgtaattgtatttgaaattaaatttgaaattaaactttaataaaaacactatgtgaattgtagatttttgtatttttttgtataccaaaaaatattaataataatgactacatttctaaatacacttgttgaatacattacctccacccatttaattaactagctaccactctggatacaatataatcccactccaaatacacattatagcaatctcccagcaccactacaaatactataactctccacaagggcctgcataaagttttcaatgttttgattgactacattttttaggcgtaccgacaatcgatccaacagaggttaaacgagtcaagtgatcctctagcgcgttgatttgcttttcgtttgatttggccatcgagtctagtcgatcctggagtgcatcattaaagtggtggtgttgacccacagcatcatcactacccttgaccggttcgtgtatagtctgcgacaagtcattgatggccaactccttagttttagtattagtattagtattcagaggccctacattctctacaaatgcaggcatcggtaggttgccaatatccctagtattaccactagctcccccttgcacactcgtttgatgtttagggtgcgaccgacgattcgtctcagagtagtaaaacttgacgtgtcatatttcatgcctgtggtgatcaattttaccctgagccttgtcgtacaacggctgcattgaattgtacatgcgcgtgattagatgaatcagttcggtcgttgcactcttaaagtttttaaatgtgtactcggtcattgttgcacagtcgcacaagctcagtttacactgtatcgatcagtggcgctagtagtctgccgtcgggttttcttgtaatattcacacaagggaattsycactaatcgctctacaataaccacaaagagggcaacgaccagcaacaatagcagcattgtgcgtgtcaaatcatttgtgaccaatctcaaacaatcgagaagtcgccatttaatggcagcgcctagactacatgtaagagcatattggcgttatgcgtatatgtgcaaagttttaaaggatgataaacgctgtccgttttattcagactagtgtgtcagagcaactcgtgtattcatcatgaatcttggaatgctagtcagtttgatcgcgttgagcgtggtgtgcatttgtaccgtcatcttgatgtggttctcgttgcatacgttgaacgccaccaagattaagacgccacgcgaactcgcagactttataagcactcatatgaaaaagaatggcacctttaccgtagcgtttacgtatcgctacaatactatgtcgacagtttgggtaagctagtgcgcaaatacgaagacttgccgataaacaatctaggcaacccggtcgacaacgttagtttcacagtgaccaacattgaaggtatgttcaagtgtccggacaattggatctggcgagattcggaaaagatgtgcaaacccaaagctatatgtcaagtcgacgacccgatcggtacaatcaagggtggggcccaccacggaaccggtggtggtcgacgatgccgactatgaatttagggatcaactaacttctaacccaaaagtcaaaattaaaacttgtcgttgtataaacaacaaagtctacaaccaaaaactcgtaaaccgtgccggtagcgatccgtgcgtattttatgacgtgtgtcaaaacaaagaggacggttatactcatgccgataaaattaacgattacacgcctagcgaatatgaatactactcttgtcacaattcaactagcgtacttaaatcgtgcaaagccggtctaatttatagcaagattcttaaaacttgtacttttaggaatttgtgtaacgacaaaccaaacacgtttacgctaaagattgacgatactcgtttcctaaaatgcataaactactcggaggccatagtgtcttgtcgctacgctctggaaacgcgatccggtgaatactatacggttacgcgcaaacgtctcaccgacgatccgatccgagtgcccggttcgttgaggcactcagactgctggcggatcaattgattgtaaccaatcctataacgattcgctacaactatgcatcgccgtggttagagtacgatctcttcaagggtaggccgtttaatgtcaaaaagtggaatcgcgtcgcagacgtggacaatccggttagcgtttcggtcagcgataccgacaaggctatcgtcttttcatctggtgcacaaggaactggcaccggacggtcacgtactgtgggtaatgtttagacgcaaacgcagtcagccattggacatgtacagcctrtccaatctgttgacgacaaagggcgccttttacgtgaccgaagagtttatcaatacgggcatcgttcgcatggtggagggtttgccgtttgacggtaaactcatcaagaacggtaccgtgatagagtttaaagtgtttatgaacgatcgctactacaacgttaccgtaccgatagccagcagtcaacagctgaaacagtttctagtcacaccgtcggtggtgcagccgggttcgtttaaaacgatcgagtacgacgagtccaagtttgactatgacacgtatcgatactttatagtgaccaacattatgtttactcaggaaacacgccttttcggccgagtctgtgccgtgcgtgtccttcttcatatcgctgttgcctctgtccataatgggttggttgggtgatgttaaagactttgactatcgaagcttctttacacaggacccaccgattggtggcagagagcgtcggcagaatatggatacggtggcaccacagattttattggttctgcctcccactttggaggaggttgacgagtcgattgacactgacgaggtcgtggacgatgctctgcgtaggcgcaaatctagaatcgtagactctagcgagattgctgaatttgacaaactgtacaagtacacgcgaatggtactcgattcaggcaaagaattgaaacggcccgatgaggattacgatgcgtttgtggcagcgttgcctagtagaattatggaaaagctagagagggaggggaaatggaggcatagtttgaaatagaagcatagtttgaaatgtaggtatagtttgaaatagaatgtaaaatataggtagtgtaaataaaggaaggtagtagcattactagttttagattgtagactatggttgtttatacacacaaatacaaagagagagaacattaaaactgttgggtataggatttggtatacatgataggtttatagaaaaatagagtacaaactaaaagcatacacaatactggcacacgcacactttcaggcaagtgsccgcatggtcatmaaatgggtggtwywtgatgtagtgttttatagtgwgttgttgttttgttgaacctatagtttgtgtagtttgcttggagatttttgctttgagtattttacaattgtaaaggttttgattattttgatcaagtagttaaaatacacagccattggtaaactacacaaactgaagcaagaaaaggtagtgtggtgtaggcaatagaggcatgcgcgtattgggttrcctttgtttggtttgcatttccwagtatgcatatgtgtatatatatttatataatgtgtaattataatgtgtaattataatgtgtaattgtaaatgtattcttcccattctattctattcaactctactctttatactaacaaccttgcacttgctttaaacttactaacattcacactacttgatttgatactgactaaactaatgaatatctcttgtatgtttatagatggtgacgactcgggaaaggacaaggctggggacacggacaaggctggggacacgggtaaatctgtagagggaaagaacaaaactctagagattatgaatcaaactatagagaccaagaataaaagatggtgagggttctaaagcaaaggatgaatccaaaacaaaggatgaatctaaagcaaaggcaactcctaaatcaacagagaagcatgagtctaaaacaaaggaaactcctaaatcaacagaggggtccaaagcaaaggcaactcctaaatcaacagatgagtctaaagcaaggaaactcctaaatcaacagatgaagctaaagcaaaagaaactcctaaaccaaaggatggttctattcccagctcacttgtacctagtggtggcaaatttgccaagcctacacccgattctagcacacccggtaaggacaaacgagaggttgttagaatagacacggttggtgatgctggctctaaatctggtactaaacatgctgttgttaaatctggtattggtagctctggtaaaggctccggtactggctcgggcacacctaaagttgcagtagccgactctagtgttgagaaatgtcagagggtgaagaggatattgatgaatttgatgaagagagcgcggctgaggcagaaaaggctcggaaggttttgcttgactaaatctagtgatgtaggtggtgctaaagtagatgataaaggaaaggaatcaaaaagtcttggtaaaacagaggacaagggtgttaaagtagatgacaagggttctaaagcagagggcaagggtgttaaagcagaggacaagggtgttaaagttgacaataaagaggaatctaaagtagatgataaaatagatgacgaatcagacgactctggtatggacattgatgaatctgatgaaacatctgaagaagaggcagaaaggaatcgtaaattgttaatgtctacatttgaaagtttggacaaggaaaagactgaaaaagtcaaagttgacgacaaggcaaagactgatgaaaaagcaaaggctgatgccgctgcaaaagccaaagctgagaaggctaaggctgatgccgctgcaaaagccaaagctgatgaaaaagtaaaggctgaggaggcgaaggaaggctgatgccgatgaaaaagcaaaggccgatgccgctgcaaaagcaaaagccaaagctgaggagaaggcaaaggctgatgcggagaaggttaaagccgatgccgctgcaaaagccaaaactgagaaggcaaaggctgacaaggctaaagaatcaaaagagctagagtcaaaggataaaactgaaacacatgaagatgtaccagatgagttggacgagtcgggttatcatgaagatgaagagccaaccgagtggtagcagkggtagtggtagtggtagtggtgtcggtactggtgttggtactggtgcaggtgcgggtaagagtactggtggtgctaaggatgaggttgatgctaaagagaaatctgaatccaagccagaaatcaaacctkaatcagaacccaaaccagaacccaaaccagaatccaaaacagacagcctagatgaactaatgcccgagtccgtcgacacatcgaagacggcgctaccgtcaatgagtaaggttgatgatggtaaagtaaagaaacgtaagcggtcaaaggagattgatgatgttgtagatgcaaagaagacaaaggaagctagtggtaaactaaaagttgatggtacactaaaagctgatgttgaaccaaaaactgatggtaaaccaaaagatgaggttaaatcaaaagctgacccaaaggacaaagctgaaccaaaggacgctgctacagaaaaggagggtactaaaccaggtactcgtgcttaactatatacatgatttgattagttttactttgatttgactatatgactcttgttgtactatactcataatatgtaattgtatcatttaacaaaacttttgtattacatcttgtaactcttgttctaaaaaatatcttgtaataaaaacttgtaataaaaaatcttacaatatgtaaaaaacttgtaataaaaacttgcaataaccaattccccaactaaatattgtaaactttatattgaattctgttctaatttttaatcgtgtcaattttaaattacaggttctgcagacgagccggatggatactcgtacgacagtgaagaagatcttgagacgcacgtagtaataggtaacgttgacaaatcatctacttctgaaatagtagagccaaagggaacgttaggttttgtggatgtgaaagaatctacagaagagggtacaagaaaatctgcaagtttcgatagcaaatataaaacattattatcgatagaagacattacagagcttaaggctgcaatgcacggtaaaaaaggcgccaaagagaactttgatgattctagtgaacttgttagtaaaaaagcaatgaagatgggtattgaaaaggaggttgttgaagaaaaggatgttattgaaaagagtagtgtagcatcaagtactgaaactggttataccaagcactgaaaaggcaacaaatccacccaccattgaaaagacggttccagcaacggtgctagaccctacactagttatggaagtggatgaggatgacgatgactatttagagactgaaccaatggatgtagatatcgagtccgagcctgagcccaagagtgaatcggttccaaaggatggttctttagaggtaatgaaggatggcactttagagccaaaagaggtaaaggttgtaaatccagttatagattcaaaggaaaagactgtaggtgagaaatctgaaatgcatgtagattcaactgtaggtaaatctgtagtggtttcagagccaaaagtagtcgatgtcaaggtagatgttaagagcgatcctaaattagatgccaaagttggtaaattggatgataaatcggaggcaaaaactgaacctaaaaccgacgctaaaattaatacaaaaacaattgaccctaaagtagatggtagcgttgaaacaaaggcagagcccaaattagacaaagtggatgataaatctaaagatgaggttatgccagagagtaggccagaacttaagccagaaagcaagccagaaattataccagagagtaagccagaaacgaaacttgaggttargccagaaattaaatcagagagcaagtcggaagctaaaccagagagtaagccagaaattaaatcagagagcaagtcggaagctaaaccagagagtaagccagaaattataccagagagcaagtcggaagctaaaccagaaagcaagacagaaactataccagagagtaagccagaaattataccagagagcaaacccgaaactaaaattgaccctaaagttgaatccaaagaatccaaacctaaagatgaccctaaagtagagctatccaaagctgaaaccaaggtagttgaaaaacctaaaactgatcctcctaaagatgatccagaaccaaaagtagaaattaaagtagtggaccctcctaaagctgaatctaaagtagtggcagaaactcctaaaattgtagaacttcctaaagctgaatctaaagtagtggaccctcctaaagctgaatctaaagtagtggcagaaactcctaaaattgtagaacttcctaaagtgaatcaaatctaaagtagtggtagaaacgcctaaaactgtagaaccacctaaagcggaatctaaaacagtggaccctcctaaagttgaagttaaccctcctaaaactatagaaccatccaagactgtagaaactcccataactgtagaaacacccacaattgcagagacacccaatccttcaactcctcctgattttgatgaaccatctatggaatcgttcgacgaaccgatggatgttgacgaggacgaaatagctccggcatacaatccattcaatgtagttgacaaagagcgcgaagaggttaaacgcaaagaggacgaagccaaacgtaaaaaggccgagtctgaagctgagatgcacaaagatcatgaaatgcactctagtgagtttgaacctccatccattgacgagtccgaggagactgagactgacgagtacaaggcgagtgcggctgcatttaagaatatgttcagcagcatggatgctggtgaaatgccagaatcgattcaacgcaaagatccaaaaattgtagatgttccatcaaagactccaccaactttaccaaaggttgtagatgcacctctcaagactgtcgaacaacccaaacgtaaaaaagagccaaaaagaggaacctcccaagactatcgaacagcccaaacgtaaaaaagagtcaaagcgcaaagaggagcctccggtaattccaaaaaaaacgtattgcagaggaaaaacgtattgcagaggaaaaacgtattagagatgaactagccgccgaagccaaacgcaaagccgacgaggaagcgaaacgtaaaatcgaatcaggtgaatttaaactccacagtcgaatctaataaacccataatggctctactttataaactgtttaactaatcataaaccttttctcttgtttcagaacccagcgaagagtacaacggaatggcagactttatggccgacctagaagattaaataagcacatcataataatgtaatgtaatgtaatgctaagcgcaaagtgtcgagtgtagataagaaagcaagtttatctaaaacgtattaaaagcaaagtgcaccgagtgtatcaaatgcaaaagttttactttgtaaatgtaaatgcctgtgcagttttaaactgtaccatagcgtacacacggtctaaaactgaacaagcataactttagacctaattaataattgcggataagaaacaatgtatgttgtgttttagttaagattttgattgtagaggttggttgcacattaggttaagtgtagtgtattttacttgtagtttacttgtaatatacttgatcgataatatgcatacttgcttgtatgtttgtactctatacttgatgttgttagaaatagaaacaaatttcatttatcaattccattagttgctaatttaacaaaattccattagttgataattataaacaaaattccattagttgataatttaacaaatgagaatattttcatcacaactttacaccaaatgtattttataaaaaataaacacttgtaaaaaactacttgtttttagtcaaaaaactacttgtttttttaatcaaacatctacacctacatctacatctacatctacaactctatccaaaattctaaacgtctctagtctttggtatacaatacaactgtttagtataacatacaccatccacaacaccccacacaacaacaaaggaaacagtgttgtgcaattgtgtgcaacaatgtaacaaatgttcaactcttaataaaaaccgacacaaagtattattctgattattacctcctccttctggccattttcataacctttcatcacggccaagtatcaatattctcaggtttgagtataaagcaatagcctattggtgttatttcaccggtcagtattgtagtttatgaaacatttttcttgtattttttaacaatggacttttgttgtgtaggtttataggattgatattgtgggtaggtattataaatggtttacagtatcgtgtgtgtgatttgtgtgatgtaaccttactacactactaataataatacttttgtaatgtgtgcgcatgcacgtacagagaataaaactttatagtagatgaaccagggtgtaataaaatggtcaagagtattgttttaatatgggtgcatcatagattatgacattaggtaaagtgccgagtgtagaggtgtcggtaggtagtggtagacatctagcaagtatacatgcatatataggtaacatttagtagctctacatgccggcagcagctagccataaacctctagtccactttcaagaacttggactctaaaaccaaacattaaacacatggtttaatccacctttatgtgtgcatcaaggttgaattcaatttcaagcgagtgaattatttcacaccattcagtgaccagaaccgggcgatatgtatagcattacatacaaacttttgccactctgacttcagtctgacgcacactgtccactgtacatcattactggagatgtctagatacttgtacatttctagttttttagactggggttaaaaagtcaaacagtgtataatagagtacctactgtttttatagtataaaccatgcttgttaatgaatctgtgcagtgaaaaacaagagtcgcccaatatacatggacttgactttgtataaatacgcgtgtgtatagtagtgttgctactttgaaaccaaaacaaacaaaacaacctacgctgtagtacacagtcataggatagataaacggacaagtataaaatacccgcgcacaacacctacaccaaccatagtgcttttgctgttgaccagtgtggactgtctggactgcaatacctactaatagtactacctactgtattattgtggtttttaaataaattaaaataaaattgaataaataaaatttaaatactagacaaaaaaatggaacccatggagtgcaagcccagtacctgcattgagagtggtgttggtggtgttggtggtgaagagtttacggcacctacgattactacaacggccgcgatcaatgctgctgactcggactctaacctaaacctaaatccaagcaacctaaatccaagcaacaccattatnaatgcaaccaaccctactactactacaacaacaactaccacaactgctacaactatggccactaatgatactcctccaaccactgctaccctgcatccacaaacgattgcaactcggccgacgagctaatgagtacgttgcgtcaaaaactcgtcagactcaaggagcgcgtctttaagaattgcaaatcaaaactaccgacctggaacaacaccgacgagactataaacatggtgcgatcgcaatcgtgcataaatcggtgcttctttaaactggccgaaatggatcaattgagcaactttagactgagcaacgatgccggcctgtttatggatctgtgcgctggaccaggtggcagattgagaagctacccaatccggcagccgtcaaggtgtacactgtggacctgttgaacgctcacgatcgcgaacgcttccgacggtacaagagtttccattacgagctagtagccaagctggcacagagacaaattagcgcattgcatgatttactgaaacagacaaagaatacccccttgtttgagaagggctacatgtttatgaagaacgccaaatgtacaaagactctgtttagcgtcactcccaaacttgtagacagtctaaagtgcatcaatactgtggatccggatttgttaaagtgtacacgacgagtgttggccgattcaaagagtgaccatatcggttttataaccacctcaaacgaaccgcacaaactgagagcgatggaggcagacgaaaccagtacgattacggtgcctcggcttttactggcactggtggtggtgctagttttgatgctggcatttaacaaaaacaatggtcattgtagtattggaggcaataataataacaacactgccaacaacaacagaggccaccgttatgccaatcgtcgcgctaaacagtttccgcacttttattactattttaacaaatctggagcaagagtgactgcggtacacgtgccaataaatcagttgaaaaatacacacaaggtccagtgtagagttgtacattcgatgcaagttttgagcgactatacagtatcgtttacacttccaccgggcgtggtcatgtttgctctgtttaacattgatcacaaaactaaacgtttatacaatgtaagactgttggacttgatgcaaacgtacaacgccaactatagcggtgactcgttgcaggtgcgcaaaaagattgttaaagagtttaaatacttatacagcatcggccagcaggatcctaacggaaactgcgatataaaccaacgggaaacagctggtgatgcaaattatcaaacaccaattacaataatactactactaacaatgcccgagagtccaagtttgataccgatgtattattgaacggtagaggttcgtttaacatgtgcaccaagtacattaccgtgctcgatacacgaggcggtgatttggtcgaggatgatctagagtttggtagcgagataaagttgtaccagtagtctgccttctctagacattcatccgatgccgtctagtgcaaagttgcacagatccagcaacgtaatgtgtctcgacaagagtgacgagtttgtcgactgtgccctcatcgatgacaagcccattgtgcagtatgcgcaacgcaaagactcgctctttcagtgtgagcgcagcytctacggcaaaggtgaaccagtctcatttgatgtacgattggtgtgataatgatttttcattttagttgaagtttctacatttatactatagattaacctttattcaatgtaaacatttttagctattggtcttgtgctttaatgttgtctgtacaatatctatgattgtacaatatctatgtctgtacaatatctagctagtttgatgtataattacaacatctttcatgattgtgtaatatctatgattgtataacatctagtgtgtaggtgactgtataacatctagttgacatcaagtttgcattttactcataggtttgatttagagggttaatttagaggtttataattaaatacctacctttgttttggattgtaatgcccaacttttgtgttgagatttattgtcctagttttgtattgtacttttagatgtttatttagatgtacggtgtaggtatatcatttagatgtattgtttagatgtatcatttagatgtattgtttagatgtatcatttagatgtattgcacttttaataataaggagagtaggagactaagtatggccacacaatgatctttaaatggtagcttagtttgtagtttaggtggtagactaggttggtagaatagttggtagagtaggatgttagagtaaaatataaagcatgtattagactgtaatactcatttaatcaaatatattacaattacatgtattcctaatgtattcataaaagcrcctaattgagtacattcttgttttttagtcactataaaagtacctacctatgataaaagaccatatactaaaatgcatacctaactattcaattttagttcacttcctcaataaacggtactacatcatagcagttcacagcaccacatttatacatggaaataaacttcaactataggtagtaggtaggtacgcattggtagaaataaaactacaagtataggaaccatacatgtgtacagacctaggcatttcctgtgatcttctccacattttacaccttcctctctatacccctcatttatatccatctatattaatttcaaatttattatcaaccagtaaccaatttagataatcctatttatatttgcatttatacactttaaccatttcccacatttatccatttcccatttataatcatatcctttggatgtttgttctacacacccgtgctcaggttcattatctgaaactcgtaaaatgagatcgtaaaaataaatacatagtgggtgcgattatttgcgcatgcttgttgtgcattttaaaattgaatgggatctgtactaggtgtagtgccatggagcgcgacagattagcaacagcagcagccagtgcacctagactctatatttgtgacacagagggattaawggttcgttaaaatcatacaatattatcaacgataaatactgcgctgctagtattaacggtgttcacagttatatatattggcagagttaatacctgatgtcgtatacgctgcttgtatactttaccgtgtggcggtcaagagttgtgcgtgtgcgactgattaaaaactcggwgcattattattctagtgtacagtgaataatagttaccatttatttgtacaattacaarctacaaactataaaataaaatgtgaataatcagcagtatcagaatcagacgcaaactcatacttatactcagaatcagattcagactcagactcattggtaaaaatgtacgctcgcgtcttcaacagtctagtcaacaacagtaacaacaatagtaatggaatcgatttgacacgcttttactgtaattgcaaaagtaacgatgtcggtgctaaattgaatagattggaaatgttaaaccgttaatatttaaagacttggagagaaccggcgacgtggctcagactataatcagtttctttaacgaacaccattacaagtttcacagagagtgtaataaaccacacaagtgcaattttcttttgcaagaaactaatgacaagaatgcatctaaaccttacaacaacaatgaaagcgttaacgctgaggccttttatagaccccttgtacgtaaagaagaagagagacaaagaatcacgatgcctcaggttgacgagtttttaagcaacatggctgacagttcaatcactggcaaacacgcactattgtacgagataaccagacgatgcaactctatggaactaaaatgaaaataaacgccggctcaaagtgcatactggaagcgttgtcgcccaccgcatacttgatgtttcaactgtccaaagatttcaaatactacaacacaactacaacaactactacttttagacagtgtacgtgtacaaatatagctctgtacaatactatacctaatgtaattaataatggtaataatggtacctttcaatattcaaacgatgcaataaattcccatgatgtgactttgcataatttgcaattgcatcaatccaataatactaacaataattctcaggacagtgtacaatttgaaaatgctagctgtgtgtggggtaatcatttaactggttcatcttttagtacaggaggtaatactatcagtacaggtcctataaacaattctctagaaccttggtcttcggtagagtgtccatcaaacaatgtactaggagatgtagtgaactccgagtctttgccttttaataatgtagaatctttcaattgtatggagccgttacctttcaatagtatggaatcgttacctttcaatagtatggaatcgttacctctcaatagtgtggaatctttcaatagtatggagtctttaccttttactaatgtagaacccaccaacagtatgaaccatagcatcgaccagtacagtgctatcgactcgctatcattattcaatacttttaataatttagactttcaatttaataataatcaagcatttgatgtcgaccaagcttttgactctagccttaatcaatcatacaacaatcaagtctttaatgtaaatccaaaccagacctgtaatacacctcaaacatcttttaatgcaaatcatacacctcaaccgtcctttaatattataatataaatccatcctttaatataaatcaatcattcaatacaaatcaaccatcctttaatataaatcaaacctatgccaacaacagtaacgaccaaccaacatctaataatattcaaactaccatatccgacaatgcacactcttcctataatgtcaactctaatttacaatcctataataccaaagagccatacatttatcatataataacaacaacaacaataactctcaatccaatgcatacaattccaataccagtgaattcaataacccggacaagtcactctttaacaacccgtgcagtaacaacattactagtgctcccattgaaaacttgcaagtgccccagactattttagatttagatttccaagagtcgccgttcaacaccacctacaatacatgtaacacaacttttaacaatctaaacttcaatagtataccatacaatacggtgccatttaatcccttgcactctgacgacaaggccaattttgtgcacgtgcaaccgcaaaggagaccacccaaactacaagccaagtctaaccacaaagggtgtcgtaaatcttgcaaatgtaaaatgtgcaaggactcggtggatactgcaagtgtggtagattctataggtattggtggttgtggtgttggtgttggtattagtagcattagcggtaaagtacaagattgtagagtgatggattgtagtataaattgtaactcgatacactatccacaaacaacactctaccaacgactcgttataatcctataaattccaatactctatccttttccgagtactttaaaatgctagcaaagatgcacacaacagatgatgtaaaactcttggccagtgccaataccagtgccagtgctgtaaataccagtctagtttcaaatgcaacaagtttatgtataagcaaaagtacaaacacgagtacaaattcaagtttaagcaaatgtacaaattcaagtataaatacaagtacaagtatagacccatttcaaccagagaccaccaaacaaacctatatacgctattgttataaacctaaaaactcccaagttgaacctaaccatggacgaaccgatggccacagtggccccgatgttggctgcccagtgcaagtccatagaggtggcctttaaaaagtttcccaatggcatgatgtgcgagtacaagtacgacggtgaacgagtccagatacacaagagtcgctcagacttcaagtactattctcgctcactgaataccgtttgacgccatcggtgtgcacaagcgtaaagcgttcaaaagcgccaaagtgtgcatcgtagtgtttgattgcatgtactttaacggacgctacctgtaccgagagcctctgtctgttcggcgagacattatcaaagacaacctaaccctgatcgagaatcgtatagttctctctgaacagaagcacatcacctcacccggtgaccttatggaagagtttaaacagtgcatgcgcttaaacatggagggtctgatgctcaagtgtgccaattcgtgctacatgcccggcaagcgtagatggctaaagatgaagcgcgactactttaagaatagcggagacactgccgacttggtcatcctaggcgcctggtacggcaccggtcgcctgggaggtctactctccgtctttctacggccagcctatcctttaggtttccgcgtgtcattagaatcagaagcgacaaggactggaccggagtaacgtctctgcgctacattaaagagttggcctctggtgccggtaggctagagtgttgtaatgatcaaaagtctgtcgagatggaggaggcggaagatgtgtaggagtaggatgataaatgttgtagaggataaatgttgtaagagtgtagagtgtacatgtttgaatgattagtttaagtcaccaatacttttatattgtactttagaatcatccttacttctttacaatttacaattgtactatactttacactttacactttattattataattttatatatttatagtttatattttttgtaataaaagtttataaaaatttgcattacaagtgtttaaaaaactagaacaagtaccagtgtaaaaagtaagactatgaatacaatctagaactaaatgcaacttaactcgacacaaaagtaaatacaaataacaagtattgttataacattaacccgtaaactttataaataaacgtgtgttgctaaatcagtctgtgtctcaatgtttcaactctaaaaccaatcctacctaaaccattaaacactcttattattagccgctatgcaacactactgctacattgatgtaaaatgcaacatgacattatactccaaagtcaatcacgtaccatcaaccgaatctatagttttagatttactccctgactctttggagagctctggctctttagtkgsmtmygattctttagagggttctgatttagacaattctttagatgtctctgatttagacaattccttagaggactccttagaggactcttctgtcttgctctctaaaacatccaaatcagcctttgagccaaccgttgactatcgtaccgatccatcaacagtcgcttgcacaaagtgtacaagtctctaaagctcaagttttcatccaaaacgttgccaacgttaaagattgatctgtagagtaccatcgagtttacagcatagccaaacacgatgagtgctaccaaaaaaactagagcgatgactagcaccgctcccagcgtgcacgacacaaattgagtaaacaccattttatcgttcaattcacaatactcgattagctgctttgcgataatacgctataggtcttatcgccgccaacaagtatagagacgcatgctttaattttttaaacaaaactaaccatgcaagagactgcggttgaaatgtgcatcaagcgtttgaaaaactcttcgttcatcattgcacactatttcatacgcatacccagtttggatttggagattcatccgggcatgtatcaaaagggcaactttttgaatttaaactctaccaagcactatcgagtgttgacggtcacgtatgcgtgtagcgattgtctcaacgagctcctgatcaagagcgaaaacgtaatatccgttgatcaattgcgagactctgaccaagggattgtgcatcggtgcaccttggagcatccaaaccatactgtctacgtgtgcagctaccgtgatgggcatcctatttaccaagtatraagcgtttacggccactctgctgactctgtgcgtgctagtcatcatgattctgtgcatgcagtacaacgtccggcaagatgaagtctacaagtgtatacacgtttaaatcgtactattgtgcactccaataacctatatcggttgtgattgtaaatggtaatgattccttgacgcttctatgcatttgcattcaaaagtttaaaaatgagagtttctttatacttttacgattcccatcatcgaccaactcggccggatgcaccgtccaccgatgtgtacaccaagtgtacatttatccgccgactctgtttgagcaccatctcaactatacaaaccccaagaatcgattcatgtactataaaaactttgtaccgcaaacgttgggtgatcacgttagagtttcactaaaagtgtagattttagcataggcattttttttagattatgtcattatatttttttagttacaakcactgcaaayatggacgttgacgatgagyacamyttgatcgagactcgagtacgaaactgtcgcggcgatgacgacgttacaatgcggtagcgcagtgggatcccaaacagtccagcaatgtaaacgttgcctacattcgcagtagaaacattttgctatcgatgcaagtcgtctttcaacaacgacaacacttctgtggaccgagtgcgtagactctttctcaccaccattgacagtaagaacaagattattaacgtggtggttgcagaggtgctcatggactatgacaattccaattcggaacagttggtggtcgagtctatggtgctgcctctcaaatcaatcctagctttatgaacgatttacagaatcgtttgaatgtcatcaacaagattgtccgagactatcagacgattcagttgagatcaggcggcggtggaagcggaggtttcggaggcggtttcggaggctcaggaggtgccggccggatcaggtggctcgggaggtgtagatcccaatgttgtagtagattttggaaataatgtcaatctaaatggtaatgtagagtttaatgcaaatgcaaatggtaatgtagaacctagcggtagtgtaggtggtgtaggcataggagtaggctcgggaaatctcaaaacatttatgccaactctgcagacgcagactgacgatgtcgatagatttctaatgaatcagagtgttcaatcaaacctacaagcaccaatcgtgccgatggatgtaaactttaacaatgcaaatgtcaacactgtaaatccagatgctttcaattctaatgtttttgatcaaaccaatgtcgaaatggttgaagctcttaaaaagagtcaaagcaaggtgacgcaaccgatcaaagtgatgcccggtacaccgatccaacaaatggtgcagtttgccgacactacaatcacaccgatacgcaatccagacgttgacatgcgtccgagtagatcgtctacaccaaacgaatcgttaataaagagcgagtctgaacttgatacgagcataaacattgtaatggaaccagaaccaatgattgaacccgagcctcaacaaaagacccctgtaccaatgagactaccggtcagtattcctttgccccccgagagattggtcgcgtttagtaaaaacattaacaacaatggaaatgtagatttgtttaagaatgctaacaataacaacaataatactagcaccaatacatccattgttagcaacgatacatccattgtcaagcaaactgtaagcaccgacttgtacgaaccgtcaaacgttaaagcaatcatgcagagcagtacaccggtggtgaaaaccaagggcgtcaccaaagccaaaaccagagccatgaagagtgtcaagcatacaagaggagacaactcagcaaactgtacagactgacgacgatcaaatcatgcaagaaacggtccaacagacggtgcagcaaattaaaactgaaaccaaaacaccaacgaaacgacgaaggataacggccatgaaatcgcccagacagaaacgctacctgacgccagagtttccagcaacactactagtggtagtactgctgccattacgcctcctaatactgttacaacacctaccacgagtgcaccacctatcaagagcacaactactgccaagagtgaaacgcctgttaaagagtgcaactactaccaagagtacaccaccacctactaagagtgcagctcctgctaagagtacacctcctaccaatactgttgttgaaactgatgccaataaggttactgacaacagcagcgccagcaacactagcagtgccagcgacactagcatgtctccaccaaagacgcccattgtacacaaggccaaacgacaaaagcgcaaactcaacgatccccaacaactaccaactgtttgatcccagcggtgatggcttcgaccctgttcaactgaacaaattcaaacagattagatccatgtttaacctaatgtgtaagaagcagggtagatacaccaactacctgctcaacaccaaaattaaggataacatacaggcggtggtgaatcgattcctgggtgctgtgcaagccacgataaaggagcctgctttagatagcataatagccacgctcgaagagtacgagtctatactcaatgatgacattaacgagtcgtacgaagatgaccgtcgagcgtatcgaaacaatgaacgtattgctgcactcttgcaacagtaccgcgagagcgatgaattcatcaaagccggtataataacgctaatcagtcaatcggagggtttcgaaggccccgacgtggacgacatgctcaacaagaatcctttgccaaagtgtacgccaaagattatgccacgctagatagactatccaagggtacactggccaagttcccaaagcctagcgtggaaccacccaaggatatgagcgtttcaacactggttccgataaactttatttagtagagaacgagtaattgttttaaagtgaagagtattttataatgttgtagagagatgttatattatatattttgcataccagtattgccagtgttcatctagttttagagtataattttagagtataattttagagtatatgtttagagtatagttttagagtattaaaatctagagtttagtctatagagtcaccatcacatggtatgaaatcttgagagtatttatagtagttgtaagagtatctaaaagatgaattgtaagagtatctaaaaggagtatctaaaagatgaattgtaagagcatctaaaagatggcttttaatcacaattggtaagaatgactacaaggataatgtttgtaatacaacttattttttattaaaaaatttaaatatatatatatatatatttatactacaataccaagtattattcattattattcattattattcaaagtaaatcaaagtaaaataataccacattttttatcctctacaatattacatccctagtatataaatctcaacaaagatgcacaaccgttaatacacaacactcggtcattcggtaggtacctacattgcccgcaaacacaacagcaaactcaactctccaaaatcaactcgttcaagagtctcggatgaaatcgtcagtgtttgtgagtacgtgtatacgatccgtgtagctcgctatggacaagggtaccggtgtcggtgcacatgcacagtgttgtataaattataaaacttataacactgaaaatgctaatcatattgttgcaggattcaccgagtcccattaaagtataccggtatcgattcagcaccaatacgctataccgacaaaatctacaaaactaacaatgtcgtttctcttgaatatggagctcgtatccagagactacaacatgctactggataattcgactcattacaaaaatgtctaccgtaaaactataggaatgagcctgagagaaaacgtgcacgactacaaggagctcatcgctactggcacatggaaactggccaacggtggtcacagttcaatgatgagcggacgttatggatgtagagaatcaacaacaggacaatgttcaaatagagaccgatgtggaatccgactccaagtctaggtgtccgtttaatgcgatgccacacttgaacgatgtagtcaacgagtttaattacgattgtcaaaagtttataattttcatgagcatctcaaactgcaaagaagtgtacgatttcaagcacttgaaaaactttgccatcgrctttggaggcaagattgtcattgatcaaaactatatcgaaacgtttgtaaatgctcctaggattacgtgaggtgtgtacctacctagtgtgtttgattgtatgttttaatttaaagtttaattttttgaataaagattcaagagtctaaaaaactaaagttttattatttcttaaacatatcaaacatwtacatacaagtacatactctacctacctacactaaacataacatttctcactctacatgagcctcctcttcaacatgaaatgagtacacactggatgcctagcgcatcgagtctgtttggtctgaagcatgcgttgacacactttataaagattgcataggcaaacgctacaatttcacgattgtgaatcatgtcgatgagcgagtcctcggtgacggtcaactctccaaacttgtacgagtctatactgtaccatttagtcttgttggtaaagagccacattgttagactctttggtagaatgagttttaaaatgtcaatattcacgagcggcggctccgagtctttgttttcattgttttgttcagccttgaactcggactctgctaaacacgtttcgattccattggtgtcgacaacgatattatcgttggccttggttgccgagtccaagtctacaagagcacacgagtttgggatcgtagactcggtcaacctgtacgagtatatcgtaatcgttcatcgaaatgaccttcatcttgaaaaatctctaaaaaaacccaagcatcaatagaccgagttcccagacgtaacataaacctttcggtccttgggaatcgtacgcttgcatcgcacggatcgttgagttaaacacgaaatcataataacaataacagtcatgattccaacgattcccacaaagtagctatgcagcgcaactccgtacggaccgattcttgtttataaactctaaatacagcgaatcgtgatccattccgagtgtgcatttatatataatttcaataagcaataaccccaataccgtattgatattaaaggcatgagttcttacatagaaatgagggattcggaagctttggatttgtgacaattctagctacgtgctcataggcacgtacatcctgaattgaccttggtagttttccattttgataagatttgattttcaaaattcctttgtctgaaacagtatttatatgtgtggggactcggagtactcggtaactcggtgtgaatcgttgactcggtggggaatcgttacatttgtggggaatctttaactctgtgtgaatccttacatttgtggggactcgttagctcgttaactcagtatgaatcgtaactcggtgggggctcttttagttggactctttgggtaaactcggtgggaatcgttgtttaaataaatgtggactcggtggactcgttgggactcgtgaactctttatgtaaactcggtggggactcttttgatagaatcggtggaaactctgtggactcgtgtaattgtaaactcggtggactcgtktarttgtaaactcggtggactcgtgtactcgtaaactcttttggaatcgtttagtgtgactcggtgggactcgtgtactcttaaactcttcggtgggactcgtgtactcgtaaactcttttggaatcgtttagtgtgactcggtgggactcgtgtactcttaaacattaattctaaactcttttggtatagagactcgggactcgttgtttccaaatcaaaacaaaccaaacttgaactcgttcgtttaaacttaaactgagactcggtcaaggattcgggctttgattcaaattgtttaaactggatcatttagactcggtgtggctcggtataactaaatgggctctttgattcaaacttgaactcgggagttgaacttgaacctgcattgtaagctcggcggcgtgactaatckttataarwctctgtgtaatacgagtccaatattttgctttgagctctacctactcttgtaacagttgacttctattgcgtatactatataatgctgcatattaaaactatatattatactatttaataatttacacattaccaatacttactaacgagttgtacataccatttaaaattaaaggttgctgggatattttaaaggcatcatccacaagactataactcaactttaacaactgtaaaatctttaaccgtagaatccaattgtttgatttataaatttggctagctagtcttgatttaaatgggggtttgaatgaatgctcgtaaagttggactgattggactattctaattggacacttgcatatagagacatagaggggttgtataaattttgtaatgatgcaaatctataggttgaagcgcattctgtgcaatgtctcaatctacaagagttgatgtgccggtaacgatacaatgcgatgagtgagtaggtagttggtattcaagtattgtatctatttggcttcttttctatacacttgcttctctatgctttgcacactgtactaaataaaatgtgcgtgtatctattgcttaaactaacatttgacttggacatttggaatacctacctaaatttagagtaccgtgttgacattcaagtgaagtgtgaaatgtacaagtggacagtgcgtgtgtgtgattattgttattgagtgtaaagtgtttatatatattcaatttagattcagtgtttgcatattcgagtcagtgtacttttgatgtaaacttttgatttaaataatatattctaaaatctaaaataattctaaacagtgaaacagtgcagtgaagtgtgaaatataaagtgtgaaataataagtgacaagtgtgaacaagtgttttgaataaatgtacagtttgtcaagtatactgaagcgtcagagtaaatgattaatgattataccaaataaatgcatcttaaatgcatctctcaggttgcactctgtaaccagggcggctcttgcaagttggcataagatcacaaatctctgccaccttcaatagtttgatcaaaggccggggctaggtactcggttgatggcattgtatggaagaatgtttgaacctaaaggattggctagtttaaagaatgatgtactagatgtgaatataatttatagtataaaagaaggatatacttaaaaagaataacaccacctgatgtgcataaatttagagtagcgttaatcaggtttgtgaaatttatgcatttgtcaagtttactggaagagcgcctctataatttagaattatagttttatagaggctataaaatggtatgtgaaaattaaaaagcctgtgaaaaattannntaataacaaaagttatactgccataaactggaccacctagtaatgtaatgcacggaagtgggcatctattatacaactttacaagccaagagattctaaattggcacttgaagtatttgatagctttccagagttgaacaaggctgacggtaaagatgcctagattangcattctattaaccaggcagtaaagtgggatacttggagtaaactgatggtaaaaccaactgacggtaaaactaaattgacattaaacagacactaatggtcttggctcttttagcggtagcatttatacatgcacatttcgtgtagtaagtatctagagtaatgtatgcatttacagacacatattgcttgttgacgggtaaattgctataataggataaattgctataataacaccaagcctgctatcaaggaacattcatcataaacataaacatttaacaaccaaccatcaacatggccaatatttacatcattaaccaacatttacattattaagcgtgtccatctaataagccataacttggcaagtaaatgattgaaacattaattggcagttgtacactaaacctcattctaaagctcaatctaaaacctcatttagcttgattgataaacattattcctagccgctttatagaccatcattaatcctcatttacttatkataatcgcaaaccattaacattaacaatgttggctcttggaatctctttatatgcatagattgaatcgctttataaatacgtgcagcagtgctttggttgggaatctttctgtacacttaacttgtgtgcttacagaaccatctagcggcatcggtcaaaacttgcacagagactggysgagtggtgtggcgaaggatgttttgagccgaggacaccttggatggtttactctgaggatgcttggattttggattttggatttggtaaaatataatatacaaaattacacaaggtgtgtatcgtttgattgttgaaatatactgatgtgtagaatgaactaagattgcaattaaatgtgtttcaggagattgagcagacaactgcacctatatactctaccttaacctgacgagggttggtaagtagtggcaagtgttggattggtaagtaatggtaagtgtttgtaactgttggtttggtaagtattggtaagtaatggtacgtgttggtttggtaagtagtgtacagtggtgacttggtaagtatcatgtgttggtaagtattatgcattggtaagtattggtatctatcaggtatgcatacttgtagtwaatcatgtgtctatatgtctataaccatgtgtaccactaatcaatacattctctttcaggtttaatcaaacttttacatgtttcagattcgagaactaataacaagtctctttgtttcagatgcactaatcaaaagtctctttgtttcagaatccttcatttgtaaagtattcaaatgaatttatacatgtattttgttttaaagttaaactgtaagaagtctgttttaaactataataattgtaatataaacaaaagtataaaacagcctactaaaaaaccaaagcaatcaaccatccaagtgtaatgctattgtactgtttcaggcgcagaggacaacccttaacttggtttcaatattgcaggtgctgtaattgacgcaaagtgatgtaaattgagcacggatattggacagctaccatacttggacttttaggttcaataaagactttactacaacaccaacaacaacaacaagtgttttactgtttcccatcctattgtcctgtgttgtttaaattttagtaaaccttttataggttctcggaagtcatcttgtcagaagtgggattctacatgattggattctaaaggattaaactctacaaggatttgaacgtgcctacaatgcagtacaagcaatcacttgaaatgtgcatcatacgctgtggaagtttaccaaaggccattcgagataagaatacctgatatcgcacacctgaataaacaatccactgtgtggtataaacaaggctattgttttcgttttaatggccatattctaggaagcatattggttgccaagtgctgtcgtcgagtgtctagaaacgtgatgtgtgctgttgccatggaaattgatgctgtggtggtgctactttggattggaatgtctaggcacaagcatggtgtttgctgcaactacttatatggttgagagtgattggcatgtttgagacggacgagtatatttgagaaggattggtatgactaaagatgattagtatgaaagatgattggtatgaattttacggtgcctagctataagttgactgcaacgtttagatgtaagatgatttgcggtttctagttttaaggatgcgttttagattttataagaataaatacacattctagttttaagtctagttgtaagtctacacaccaaatcaagagtcctttgattctagatttgagattgaactgtattggttcaatataagcacatacgctacactttacaaatcatcacaatcattacacaattcattgtacacaaaatcatayattcwtttacacaaaacattcattatgcacactcttttttttgactactacctttgactactacttgctactaacatctaatactaacctctactattaacaatttaaatgttgcagagtcacagtaaatgtctacacaaatgtctacacagaggcccacacagaggtctacatagaggctgcattctacagtctacctatggctgcattcacacaacatctggattggtttggtatagtatacaactgggttgtagcatacccatctctagtatggtttgtataaatggacaaatctagtttgtaagaataatgctaatgctagaatacaagggtacccaaatcataatgtaaaaaacatgtctcaatgttaaatgtttcagatgcgatccagcaaaactccaaagctaacccttgtgtgtttcagaggcagtcgttctccatcaaaccatcaaaccatcaaaccatcaacaacaacaagtgcacctatataaagtgcacggcaaacttgtgcaatcgtacaggttgccgttacaggtatttgcatgcttttgaattttacatttaacratgcttttgggttcctaaacctgtttaaacttgatgtgtttgttaaagttggaatgtgtgtacgtataaaccggtatgtggaaccagtttgggttcggaatgtggagcccgtctagcgtgttctgatgttaccaatttgagatgaatgttaccaatttgagatgaatacaagggacgaatgtataaatgtataatgttggaattaakcagaacttagactaaknartacttagactaagaatgtctattgaatatctacagaatgtcttgaacatctactgtagtatatctactgtagtaatacgtatttgtacatgtctgtaattgtatctatctgtaattgtttctgtctgtaatttagtccaagtagaataagaaactctgaataggttacaaacgttgtttccatttataacgaatctcggttataatcgttgattataacaacactcgactctttgacttgactcgacggtacccgactgtggtgccagcctttcagacatcatctttccatactatttactatattcaaattattctattcatcctctctctcaacatcaacatcacccctcgtagacctaagttttcatcacgtctaattttataaatgttaaacaagctctatatatatcgtctacatttgaggttataaaacgttgtatgcaaaattgaaaattgacacggttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaawttcttataatttaagcgtttatttatagctttatacgttgaagatatattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgcattggatgcatcaaaagtgtaaaatttaaagagctagaggtaaaaatgataaaaattatacaaatgtacacttttaggacaaactagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctaggttcttatcgcaacacgcactataaaaagccgagactggtgacgaacaccatcagtctgattcgagtcgtgttcataccgcactggtgtaggcagcgtctggtactaggtgagtggctcattcttatttaattcatttagtctgctctgtttatwcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcgtactaggtaggatgtttttattatattcacacatgtgcatttgaggataataacaatggtaatgtgtgcgtgycgggcatctattattaggtaggcgtagcttgcacatgtgccaccatagggacttttagttttgttagtgtagtgtttttgagtgcaagatgtttgtttttactgtgcatttacaagagacttgatggaacacttatatgtataacagtactactactaraggatagcatttagtagaggtgctgggaacaatagtgtgccgagtataatcataggtatgtgttgcaatactttttattttatgcttttacattttacgattcattacttgacactgattgatattttatacttgttgatattgtgtggataatttatgaccatctgtgggaatctaggtaggtagggtttacacatgcttacacatacacactgacactgatacacattttacaaacaaaacaaagnaaacaaaagtacattaaaacaaacggaaaaccaataccatacattctatcattctatccttctactactattactaccactatctactatggtacctaccaaacattttttattaaatctatacatacacacatggatttgtgctcacaacaacaacaaaacacaatcggttagggtcgttgggtctgttgcagtctcggcagcttaggtcggttagttttaggctcggttagtctgtaagcggtacggctagtttatataaggctaggttagatataaggttcggttagatataaggctcggttagctataagtcggtgcggctagtttataaggttcggttagatttaagtgcggctagtgtataagtcggtgtgagcacaaatcaatagatgtagtaagatactttatgaattgatacacggacggtaaacatataaaataaaaacacgggttgtacacatttacacatacacactatacacaacaatttaaggttaagataatttaggacatttaggataatgacaaagtgtctctggtaaagactggtggtaagactggtaaatactggtatataaatatactctggtatactcggcaaactttgtgtactctggtactctgataaagctatactctggtaaatattctggtagaactctgtactcttatatactctggtagacttttgtacatgtacaactacaacaacaaatctggtaactcggtgactctgactctggcggctcttggtaactctggtggtattggtattggttaataaaggtatcacggtttcaaacaaaggtattggtatcacataacggcattcatcaaaggtattacacaaaggtattaaacaaaggtattaaacgaaaggtatcaaacaataggtttaggcaaatgcacacacagaagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcgctctgtgtacgagtatcgcatcgcacaaaaacccactgaccaaccccctcgcaccgtcacgttgtctttcaggcagtctctcgtggcgtgtgcgcttgtttgctttgcaaagagattgccttagtgccttgttgcaaccgtggcgtgcaagtgtttgagttgtggacatatgcgatcgattgcctcgcagtaatcggctacgataacgctgcctggtacctccgatgtacattgtcgttaacacacaaaaaacgtgcacgctcttgccaattaactaaaaaggtttttttctttttttttcaccacccaataaactaacaattactggtgacatttgttgtttcattttatacatcctgcatcctgatacaaccttttacacaaactgctgttaggtagagtgttttgttaggtagagtgttttgttacagttagatagactgtactgtaggttgttgtgtgttaggtttgatacaaacatacaaatatacaaatacataaaaccagagttaccactagggtttgagactataaagttgtgattgagtatagagttactctttgaagagtattggtattcttgcaccgcgcaccgagtctacactacgctccgagctacactgcactccgagtctgcatctgcatctacaagctacgcacacacatcctacctgcctacatctacaagttgatgtattkntatkkgtattkgaagtatgtttctaaaaaataaaaacacttgtgtgtmtaaaaaatgagctcttttatttattaatataaaacctttacatacactctaagatactacaagatactacaagatactccaagatactccaagatactctaaatatttgatatacaatacacatgtgtataaatacaagtacactacttaaatctaatggcaatacacatggtggttacaaacaactgccaagtaaattgtaggatagtaaattgtaggatacatttattctgaattcataccaacaccagccctaaacaggctaacctctgaaccatagtcagagtcggaagaactctgcgtagactcggaagtgatgctcgaacacgaactgcacaaagcgcagcttggcacggtaatcattctttgggttgcttatgctggtgggtgcacttgcaggcggtaggatgacatccaccatgtctacggctatcagcacaaccaccatctacactgttagatttgacgattccatcgttggcaccactactactagacagtttacgataggcagcctcttcggtatagtctcggttaaagagtttgtttacgcgacgcaggcaacgattcgagatgccaccggttgctgttgttggtggtgttgccggttctacgctcttgcgggccatcaactgttcggcaaagcgcctctcaaactcttgaacatcttcgacgccaaactctcgtcggatctcttcgtcaatcatttacaatacaagatgcaatacaagtattgaaatcttgcaagcctctatagtattattagcagtggaagtagcctatatatatttattaaagctttaggtaatactagtagcctctgtgaatagtgcaacggtccaagtacaaataccatattgcggtaaagctgcaccagttttataccatgttgtggagaaaatgtagtaataaatgttacactttgaagggattaatccggtccgttatccactgccacacattaaaggcaatgttggcgtacgatacactgactagtgcaacgctcagcaggagcatcaagactccgagtaggtagactcgtaaaactagtgatgagactcgtacacttcaaagtcttgcaccgtaaacagtttggctcgcgttagaatcttttcaaactctatcgagcccacaattggtcttgagctgagagcgcaacgccatctttgagttttcatacagctgatgcaggtagtcgggcgtgtacatgttgttgaaaccgtcatcgtctttagttgactggccagttgagtgactcccacgtctacagcaacgctggcggcaaagtctgcgctggtcagttcgttgagcagcgacagtggtctgtttgccagtctgcgaggctagggcatttttgagttcacgatccgcacccgatgtatcgttgagggtcttgactagatttaagagtttttcaatgtcttgatttttggtagtactagtactagtactagtactagtcttggtaggcgttggtttagatttcatcatagcatcatcaaatcgtacaattttaacattgtcagccattggtacggtgttgggactcctcttgcttctgtgattcactcggttcattgtttccaaatcgctcacggtcacatctatgggcggtagtttaaaattgggatcgacgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgtgcaatgtctagttgggtgtaggttgtggtggtagtggtaggattaggattagggttattaggcacattagacattgttggttgtgtggattcattaacctagcatatacatacacgcaaacgtgatatttatacaaagatttatacctaatatttattaattactcgataagtacaaagactaaagtacctactaatactatggggaatgtgcacctacagactctctcttccttttgaaggaatttaaactttttgtacaataaaatnnnnnnnnnnnnnttaatgaggagttcaacttatgagacttttatgacaatatcaagttttgtaaataaaaggttattttcaactgcaacaatgtgtgatgcaaatttgagtttgtacagagtagctctattaaaaaagaatactgcaagtgttgttcattttatacacaacttgtcatatacaagtactagtaacactactagtaccactactacaannnnnnnnnnnnnnnnnnnnnnnnnnnnnnnnnnnnnnnnnnnnnnnnnnnnnnnnntaccaattcttacaataccaatcatcattatacaataccaattcttacaataccaattcttacaacaccaatcatccttacaattattacaactgccaattatagctctatgtagctctaccactctacacactccggcactcggcacactctactctacatactctactctacatactcttatcctaatactcttacaaatatttaaacaacaaataacaagcaatagcaacaacataggcggactttaagactttactgtaaactaggatgttcagactactttgataaactaggactttaaaacaaattgatacattataataaaagtacaataaaagcacaacaacccactacctcccttcaaacacctaatcccttggatctttacaagtactttaaatttccaaacattttagatccatgattaaagtacaaatctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagtcgcaaccgcttcaagtgtccgattacgtgaccgggatcgccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtacagcttgataatgtgagagatgagcgcttcgctagtgggaaactcttcgccgttcacatagtctacgtacaagttttgctggatcaggtagtcgacgttttcaaagtagacyagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgccggttagtacatgttcaaacgactggggggmacaatgtccagaaagggtggcagcttgagattttgagccaagrcttcgcgattcatgaccgtctgcaaattgaccagattcgatacgataccgttcagagtgctgtgcggtagcatctgcaccgaggcactcctcggcgtatattgaaactggtaaacgtttgcgttggccaacatgtttacctgttcggtggacttgcgcactagatcgttaaagacggtaacgtaggcgccctcctcgggcttgtacgaactctttacgttgaccctgcacgttgtgggattcatagtgttggtgatgggctgctccactttgctccggagccagaaaaagatgctattcttaaagtgggcaaagtttttgttcttgtacgcactgaccgcctttaggtactcgcacagtatactctgcaggtgaacgtattgctcgtgttggcaaagctctcaaaggcgggcagtgtcatgatttttgaaaaacacttggcaaactcgccgacggtaaaggttcgcttcgtagactcatgtagttgcgattggccttgtaaatgtttttcaacgtctcgggatcggcgacgccgctctttataaactcttcaaagagaaggagctatcggtgcacaatgcgcaaatatattcacctgttgcagagcaacaaaaacagtaaagtgtacagcgtcgaagacctgatcccagtacactggtagagattgaggtgccctacaaactcaagcgtctaacgccctgggtcatggtgccgtaccgggtaaactttaaaaaggacaaactagtcatctactctagctatatggagaacaaggacctgactcacaatgtgacatcgatgagttgccagtccaagctaagggcgctgctcaatgtggccgaagtgattcagtgcatgcactccaaattaaaatgtatgcacaacgacattaagcctgaaaacattttcatcgatcgctacaagaatgccaagctgggcgactttggcctgtgtcggtacaaggtacaaaactgcaccgctctaatggtcacatcccgatacgcgtccaccgagaagttgtcgtcttcgtacaagatttacgagaattgatagtcgagatgttgacgtacgacattagccggaggttgaccaatttgagtgagattatagagaggttaaagatggtttataaaaagtttgaaaattatgttagttagagggggatgtagaggatggakgtggatgtgtatgtagatgtaggtagakgtagaagtagactcggcagcgagatttggttgtattagttgcatttatacatggtatttattaacaactatattaactaacttgtgtatattttgtatatatatatattttgcatcaacctagttgtacaattgttatttattacctatttttttagacacccacaaatgtcaaactttgtactctttaaactctttaaaggttcccctctaaaactaaacaaacccaagatgctaaccgtcaatataacgtatccaccgaggcccaaggttccgataaacctaccaccacgacagcaacgcaccccaacaagaacgcagtcataatgggccgattgacttgggagagtataccgaaacgattcaggccaatgacccatcccaattgtcaccaaatacacttgactgcgatcaaaaagtattacgagtgcaacgtctttttccccaagatttagaagtggacgcagtcagttggtgtattgttgaatatgaaattgtggaatatgagatttatgaaattgttgaatacgagattgtttaaaagtaggtttagtttccaagtttaggattcagagcaccctttgtgtgtctattataatatacatgtatatacaattgttgttaatcattctttataggatgaaaaggtgtattgtgtatagtagtaggtagtaggtagtaggcaatggggtagtgtgttgtaaaataaattgcttagaataaattactaggaactgcaattaggtgcaattagaatatgagggtttaatttaatttagttttttaaagaaatcatcacttgtgttgattgtcataaatggcaaccacacacactcttggaaaaagagggtgcacttgcagatcgtaaaagagactgggtttatggtttttgtgtggttttttgtgagctacatgtatagctgggtacagctcactcttctggatgtcataaaacttaaagtttacgatgcccactttatatttattgcaaaaaacttggtattgtaggaaacaaggacaccgataagggaaagatgcaggttgccatcgtaaagacttatcatggaaatcaaattgtttccaccggtataattgtgcttttatttaatacacgctagacaaaggatgttttaaaattagtttttaaaagaatcaaaggaaaagttgaaaagttgtacaacaaagcgcatcctcaaactgccaacagcatctaccacccatagtctagatttttaattgggtttcgtaactattataaaaaacgctttgtgtaatgtaaaagtgtccgagtcagagtgctgggaacctttaagagaggagagaaactcaatttacagtaaaatgcagtttagcactagaatggcctgaaacgctagtatgctacagttttcaaaaaataatcaaaatatttcatacacgtgtaaggctctagcaacaacaataacaaagggcagataagggggttgccacaatacgcatgattaaccacaattatgaaactacaatgcattgattcataatacaccccttatcaccagtggtgtagattatattgtattataaattagttcatgactaggttagtcgcttcagtcaatcgcaaagcttcttatggtcaacttccggcgtagggtttgtgtgctcctgtttgtgcgagtattcagttgagctcctccctctctgctaatgtgacaagtgctctctctcttggacagtgtgtgtgtttatttacaaacaatgaaaaactctatagtttaatgacttgattttcgattcgtgcatcaaaggtgtactattagtttcaaaggtgtacacaaaaaaaatagtgtaaaacaatggtgttgaggccgaggaacgtcgccgactcaatcgagagtgccgaagctatcgtgaattcaaacgtaggctaaagaatttgaaacatcagatcgaggctgctagaaatgtggctgctacaacaacaacaacaaaatcaaaatcaagaccaaagtcaagatcaagatcaagatcaataccaataccagtgccagtaccaatgccaacaactgcaaatgcaattgctacaactgtaaatgcaacttcaactttaacatcaacaacaacaaacggactcctcaaacccctcaagattaagacgaagcgaccccacattgaagactcggatactgacgatgccgactacgcaccaccagtcgattacggtaaacgtcgacgagtctcgtgcctagtgtgccttctaatgccaatactaacaatagcaacaacaacagcaacaacaatagtagtattagtatttataatggtgttaaaagtaatactaaaagtaatgctaaaagtaatggcactaatgtcaactctgtgcatccacctcccactaccactcttgctaacccttgtaaaattcaccattgtagactttgatggggctgtcaataaattgatcaagagtgaactcaatgttgatgtggaggtgatgccaccgcccagtattaaaccgcgcaggaaaaaggccaaggctacgtgcaagtattgtcgaaaggtaatctctaaccgttccaatctgctgcgacacgtaaggggacactagccggtacgatagtcagtgttcctctagcgcagaggatttgattcagagcgataataacaacaatttcagcagcaacctaaagagggccatgcttcatggaaaacccaagaaaccctagtgctcaaatacacggacccagaggcaacggtgtagacaatggtatagtctacataaaggccgattcctatgccgccagtattattaagaatactgcaagtaaggatattacaagtaaggatattgcaagtaaggctgttacaaataagtctattacaaataaggatacaattaaggctataaacaagactaatgatgccagtataactaaaagtacaaatgtaaacaatagtgtaaatagttcaagtttaaatgaagaggacgaatctcatcaatcgatgcctgaatattcaaaccctgaatattcacaacctgaatattcaaaccatttaaatgwwmatgtaaatgaagatgtacatgtaaatgaagatgtaaataagagtgtaaatataggtgaagagtgtaatgataatggaaatgagcaaagtcaggtcgacgaactggatgcaatcaataatgtagaatgtggtgcggaatctaatgtagagatggattccaatgtagagatggaattactgaggagcaacaagaatacaccgaggaccaagaacactctgaggccgagcccgaagaaggctccgactccgagtctgaatctggctccgaatctggttccgaaacgtgtagacttgcagtgtgagattgacgagctaatgaacgaccacgtggcattttccaaagattccacaatagaggcctttaacaaaattgatgaattgttatcgacaattcaaccattaccaatgagtacaatggaaccattagctgacgatgatgttagtgaggtaaacagtcttgcaaataccatttctaatgcattaatccctaatgggtgcaatgtaatctccaatggaatgcagccccttgttgactcaggttggtatttgcacttttgtgtttactacactaaaactacctgatttactacctgatccactacctgatctatacctgatctatacactacacacgcatacatttataaatacatttataaatacatgtccaactttacaataccagacggaatctacactactgaatctaacactacactactgaatctaactgctacactgtactactacttacatccaccyataacatttacttgtaataacatttacttgtacgtacctataacaccatttacttgtataaatctcatctcgttttttagactgtgcattttgtgtacctacattgaaaatgtcctacattgaaaattacctaaataaaaatgtgtctaccattgtatgtgtatataacctaaaactgtactcatcaccctccattctcatccatttcagattgtaaaaagcgtaccaatcaactctgcgggtgactctatcaatctgtatacacttgcatgcgtagcggataatgttcagtacaatagtattataaatgtaggcaatgattcaatacctgcaaccatacccgaacccaagcatcctaatcctttacccgaatctggtgtcaatgttgataatggcaaggtgtctactaataaaactaatgatactaacagtactaatactaacaatactaacagtactaacactactaacagttaacaccaacattgatgccaattctgctacaactaatgcaaacaccaacaaccacaacaacaccaacaaaccctcctcccccatccatcgtcgggctggtccaatctggacgagctactgttcatggccgactatatagagcccacgtccaaagtgtacatgatgcacaactttaagaagcttaccactctacaagattcggtatcggacattgaaaacttgatacgcaccgaagtcaaacagtccatctccaagaccacgaacacgaaactggtattctaaagatgctctacaacattgacttgactgacgagtttttacaagttattcgttcctacgccattaaactgatcaagtctatgggctttatgctcaagcgcgaaaacttgacgcagatagatttgtgtcaattgagtgacaccctaaagcgacactctaacgtgttcaagctcagatcatttctcaactttgatatgcatcctagtttgtgaattttaccattaaactttgtgtactttgaaatgtgattttgtgaaatgtagaatgtgattttgtataacttgtaatgtgattttatgaaaagacttgccaaaattgtaaattgagatttacattttcaaaaagtgtaaatgtcgatatcg

SEQ ID NO: 24 - protein, 409 aa, Heliothis armigera nudivirus
MYSSHSILFNSTLYTNNLALALNLLTFTLLDLILTKLMNISCMFIDGDDSGKDKAGDTDKAGDTGKSVEGKNKTLEIMNQTIETKNKRWGFSKGIQNKGISKGNSINREAVNKGNSINRGVQSKGNSINRVSKETPKSTDEAKAKETPKPKDGSIPSSLVPSGGKFAKPTPDSSTPGKDKREVVRIDTVGDAGSKSGTKHAVVKSGIGSSGKGSGTGSGTPKVAVADSSVEKCQRVKRILMNLMKRARLRQKRLGRFCLTKSSDVGGAKVDDKGKESKSLGKTEDKGVKVDDKGSKAEGKGVKAEDKGVKVDNKEESKVDDKIDDESDDSGMDIDESDETSEEEAERNRKLLMSTFESLDKEKTEKVKVDDKAKTDEKAKADAAAKAKAEKAKADAAAKAKADEKVKAE

SEQ ID NO: 25 - protein, 198 aa, Heliothis armigera nudivirus
SKVVVETPKTVEPPKAESKTVDPPKVEVNPPKTIEPSKTVETPITVETPTIAETPNPSTPPDFDEPSMESFDEPMDVDEDEIAPAYNPFNVVDKEREEVKRKEDEAKRKKAESEAEMHKDHEMHSSEFEPPSIDESEETETDEYKASAAAFKNMFSSMDAGEMPESIQRKDPKIVDVPSKTPPTLPKVVDAPLKTVEQ

SEQ ID NO: 26 - DNA, 3909 bp, Heliothis virescens nudivirus
  source 1..3909: mol_type = genomic DNA
taatttagtattaaataatctctatatacatagtctacatttgaggttataaaacgttgtgtgcaaaattgaaaattgacactgttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaatttattatgcatgttaatttaagcgtttatttatagctttatacgttgaagatacattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgcattggatgcatcaaaagtgtaaaatttaaagagctagcggtaaaaatgataaaaagtatacaaatgtacacttttaggacaaaccagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctcggttcttatcgcaacagagtgggggccatccgcactataaaaagccgagactggtgacgaacaccatcagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacacgagacttgatggaacacttatatgtagaacaatactactagaggatagcatttagtagaggtgctgagaacaatagtgtgccgagtataatcataggtatgtgttgcaatactttttctttaatgcttttacattttacgattcattacttgacactgattgatattttatacttgttgatattgtgtggataatttatgagataatttatgaccatctgtgggaatctaagtaggtagggttttacacatgcttacacatacacactgacactgatacacattttacaaaccaaacaaaaacaaaacaaaagtacattaaaccaaacggaaaaccaataccatacattctatcattctatccttctactactattactaccactatctactatgggtacctaccaaacattttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggctcggttagttataaggctcggttagttataaggttcggttagctataagtcggtgcggctagtttatataagtccggttagatttaagtgcggctagtgtataagtcggtgtgagcacaaatcaatagatgtagtaagatgtgatactttatgaattgaactatagattgatacacggacggtaaacaagagttgatttgtgtagtatacgtcttcttcttcctacttcctactattataaataatataaaaaacatataaaataaaaacacgggttgtacacatttacacatacacactatacacaccaatttagggttacgataatttaggacatttaggataatgacaaagcgtctctggtaaagactggtggtaagactggcaaatactggtatataaatgcaaggatacaactaggtactgtactctgcaactattatactctggtatactcggcaaactttgtgtactctagtactctgataaagctatactctggtaaatactctggtagaattctgtactctgatatactctggtagactgtacatatacaactacaacaacaaatctggtaactcggtgactctgactctggcgtctattggtaactctggtggtattggtattggttaataaaggtaacaacggtttcaaacaaaggtattggtatcaaataacggcatcaaaggtattacacaaaggtattaaacaaaggtattaaacaaaaggtacaaacaatctgtttaggtaaatgcacacacacaagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgtgatgcgatcgttaggctctgtgtacgagtatcgcatcacacaaaaacccactgaccaaccccctcgcaccgtcacgttgtctttcaggcagtctctcgtggcgtgtgcgcttgtttgctttgcaaagagattgccttagtgccttgttgcaaccgtggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgacatttgttgtttcattttatacatcctgcatcctgatacaaccttttacacaaactgctgttaggtagagtgttttgttaggtagagtgttttaggtagactgtatgttatgtgttaggtttgatacaaac

SEQ ID NO: 27 - DNA, 3531 bp, Heliothis armigera nudivirus
  source 1..3531: mol_type = genomic DNA
taaatgttaaacaagctctatatatatcgtctacatttgaggttataaaacgttgtatgcaaaattgaaaattgacacggttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaawttcttataatttaagcgtttatttatagctttatacgttgaagatatattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgcattggatgcatcaaaagtgtaaaatttaaagagctagaggtaaaaatgataaaaattatacaaatgtacacttttaggacaaactagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctaggttcttatcgcaacacgcactataaaaagccgagactggtgacgaacaccatcagtctgattcgagtcgtgttcataccgcactggtgtaggcagcgtctggtactaggtgagtggctcattcttatttaattcatttagtctgctctgtttatwcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcgtactaggtaggatgtttttattatattcacacatgtgcatttgaggataataacaatggtaatgtgtgcgtgycgggcatctattattaggtaggcgtagcttgcacatgtgccaccatagggacttttagttttgttagtgtagtgtttttgagtgcaagatgtttgtttttactgtgcatttacaagagacttgatggaacacttatatgtataacagtactactactaraggatagcatttagtagaggtgctgggaacaatagtgtgccgagtataatcataggtatgtgttgcaatactttttattttatgcttttacattttacgattcattacttgacactgattgatattttatacttgttgatattgtgtggataatttatgaccatctgtgggaatctaggtaggtagggtttacacatgcttacacatacacactgacactgatacacattttacaaacaaaacaaagnaaacaaaagtacattaaaacaaacggaaaaccaataccatacattctatcattctatccttctactactattactaccactatctactatggtacctaccaaacattttttattaaatctatacatacacacatggatttgtgctcacaacaacaacaaaacacaatcggttagggtcgttgggtctgttgcagtctcggcagcttaggtcggttagttttaggctcggttagtctgtaagcggtacggctagtttatataaggctaggttagatataaggttcggttagatataaggctcggttagctataagtcggtgcggctagtttataaggttcggttagatttaagtgcggctagtgtataagtcggtgtgagcacaaatcaatagatgtagtaagatactttatgaattgatacacggacggtaaacatataaaataaaaacacgggttgtacacatttacacatacacactatacacaacaatttaaggttaagataatttaggacatttaggataatgacaaagtgtctctggtaaagactggtggtaagactggtaaatactggtatataaatatactctggtatactcggcaaactttgtgtactctggtactctgataaagctatactctggtaaatattctggtagaactctgtactcttatatactctggtagacttttgtacatgtacaactacaacaacaaatctggtaactcggtgactctgactctggcggctcttggtaactctggtggtattggtattggttaataaaggtatcacggtttcaaacaaaggtattggtatcacataacggcattcatcaaaggtattacacaaaggtattaaacaaaggtattaaacgaaaggtatcaaacaataggtttaggcaaatgcacacacagaagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcgctctgtgtacgagtatcgcatcgcacaaaaacccactgaccaaccccctcgcaccgtcacgttgtctttcaggcagtctctcgtggcgtgtgcgcttgtttgctttgcaaagagattgccttagtgccttgttgcaaccgtggcgtgcaagtgtttgagttgtggacatatgcgatcgattgcctcgcagtaatcggctacgataacgctgcctggtacctccgatgtacattgtcgttaacacacaaaaaacgtgcacgctcttgccaattaactaaaaaggtttttttctttttttttcaccacccaataaactaacaattactggtgacatttgttgtttcattttatacatcctgcatcctgatacaaccttttacacaaactgctgttaggtagagtgttttgttaggtagagtgttttgttacagttagatagactgtactgtaggttgttgtgtgttaggtttgatacaaac

What is claimed is:

1. A lepidopteran insect infected with a virus comprising a genetically modified *Heliothis virescens* nudivirus (HvNV) comprising a region selected from the group consisting of HvNV Open Reading Frame 90 (ORF90) encoding an amino acid sequence as shown in SEQ ID NO: 21, HvNV Open Reading Frame 92 (ORF92) encoding an amino acid sequence as shown in SEQ ID NO: 22, and HvNV Persistence-associated Gene (pag1) encoding an amino acid sequence as shown in SEQ ID NO: 26.

2. The insect of claim 1, wherein said lepidopteran insect is selected from the group consisting of *Helicoverpa zea* (*H. zea*), *H. armigera, H. assulta, Heliothis virescens, Agrotis ipsilon, Spodoptera frugiperda*, and *Spodoptera exiguae.*

* * * * *